(12) United States Patent
Park et al.

(10) Patent No.: US 8,124,839 B2
(45) Date of Patent: Feb. 28, 2012

(54) IDENTIFICATION OF TERPENOID-BIOSYNTHESIS RELATED REGULATORY PROTEIN-REGULATORY REGION ASSOCIATIONS

(75) Inventors: Joon-Hyun Park, Oak Park, CA (US); Nestor Apuya, Culver City, CA (US); Steven Craig Bobzin, Malibu, CA (US)

(73) Assignee: Ceres, Inc., Thousand Oaks, CA (US)

( * ) Notice: Subject to any disclaimer, the term of this patent is extended or adjusted under 35 U.S.C. 154(b) by 777 days.

(21) Appl. No.: 11/916,935

(22) PCT Filed: Jun. 8, 2006

(86) PCT No.: PCT/US2006/022851
§ 371 (c)(1),
(2), (4) Date: Jul. 18, 2008

(87) PCT Pub. No.: WO2006/133461
PCT Pub. Date: Dec. 14, 2006

(65) Prior Publication Data
US 2009/0136925 A1    May 28, 2009

Related U.S. Application Data

(60) Provisional application No. 60/689,035, filed on Jun. 8, 2005.

(51) Int. Cl.
*C12N 15/29* (2006.01)
*C12N 15/82* (2006.01)

(52) U.S. Cl. ........ 800/282; 800/287; 800/298; 800/306; 800/312; 800/317.4; 800/320; 800/323.2

(58) Field of Classification Search ............... None
See application file for complete search history.

(56) References Cited

U.S. PATENT DOCUMENTS

| | | |
|---|---|---|
| 4,654,465 A | 3/1987 | Brar et al. |
| 4,727,219 A | 2/1988 | Brar et al. |
| 4,801,340 A | 1/1989 | Inoue et al. |
| 4,801,540 A | 1/1989 | Hiatt et al. |
| 4,936,904 A | 6/1990 | Carlson |
| 4,946,778 A | 8/1990 | Ladner et al. |
| 4,987,071 A | 1/1991 | Cech et al. |
| 5,034,323 A | 7/1991 | Jorgensen et al. |
| 5,188,958 A | 2/1993 | Moloney et al. |
| 5,204,253 A | 4/1993 | Sanford et al. |
| 5,231,020 A | 7/1993 | Jorgensen et al. |
| 5,254,678 A | 10/1993 | Haseloff et al. |
| 5,283,184 A | 2/1994 | Jorgensen et al. |
| 5,380,831 A | 1/1995 | Adang et al. |
| 5,410,270 A | 4/1995 | Rybicki et al. |
| 5,432,068 A | 7/1995 | Albertsen et al. |
| 5,445,934 A | 8/1995 | Fodor et al. |
| 5,538,880 A | 7/1996 | Lundquist et al. |
| 5,591,616 A | 1/1997 | Hiei et al. |
| 5,723,766 A | 3/1998 | Theologis et al. |
| 5,766,847 A | 6/1998 | Jackle et al. |
| 5,777,079 A | 7/1998 | Tsien et al. |
| 5,824,779 A | 10/1998 | Koegel et al. |
| 5,824,798 A | 10/1998 | Tallberg et al. |
| 5,859,330 A | 1/1999 | Bestwick et al. |
| 5,880,333 A | 3/1999 | Goff et al. |
| 5,900,525 A | 5/1999 | Austin-Phillips et al. |
| 5,925,806 A | 7/1999 | McBride et al. |
| 5,958,745 A | 9/1999 | Gruys et al. |
| 5,994,622 A | 11/1999 | Jofuku et al. |
| 6,004,804 A | 12/1999 | Kumar et al. |
| 6,010,907 A | 1/2000 | Kmiec et al. |
| 6,013,863 A | 1/2000 | Lundquist et al. |
| 6,087,558 A | 7/2000 | Howard et al. |
| 6,093,874 A | 7/2000 | Jofuku et al. |
| 6,136,320 A | 10/2000 | Arntzen et al. |
| 6,235,975 B1 | 5/2001 | Harada et al. |
| 6,255,562 B1 | 7/2001 | Heyer et al. |
| 6,271,016 B1 | 8/2001 | Anderson et al. |
| 6,294,717 B1 | 9/2001 | Xie |
| 6,303,341 B1 | 10/2001 | Hiatt et al. |
| 6,326,527 B1 | 12/2001 | Kirihara et al. |
| 6,329,567 B1 | 12/2001 | Jofuku et al. |
| 6,329,571 B1 | 12/2001 | Hiei |
| 6,417,429 B1 | 7/2002 | Hein et al. |
| 6,423,885 B1 | 7/2002 | Waterhouse et al. |
| 6,452,067 B1 | 9/2002 | Bedbrook et al. |
| 6,518,066 B1 | 2/2003 | Oulmassov et al. |
| 6,573,099 B2 | 6/2003 | Graham |
| 6,645,765 B1 | 11/2003 | Anderson et al. |
| 6,664,446 B2 | 12/2003 | Heard et al. |
| 6,706,470 B2 | 3/2004 | Choo et al. |
| 6,753,139 B1 | 6/2004 | Baulcombe et al. |
| 6,777,588 B2 | 8/2004 | Waterhouse et al. |

(Continued)

FOREIGN PATENT DOCUMENTS

CA    2316036    8/2000

(Continued)

OTHER PUBLICATIONS

Fits et al. The Plant Journal (2001) vol. 25, No. 1: pp. 43-53.*
Shen, H. et al. Biochemical and Biophysical Research Communications, 2007; vol. 362, pp. 425-430.*
U.S. Appl. No. 60/121,700, filed Feb. 25, 1999, Bouckaert et al.
U.S. Appl. No. 60/505,689, filed Sep. 23, 2003, Cook.
U.S. Appl. No. 60/518,075, filed Nov. 6, 2003, Pennell.
U.S. Appl. No. 60/544,771, filed Feb. 13, 2004, Cook.
U.S. Appl. No. 60/558,869, filed Apr. 1, 2004, Cook.
U.S. Appl. No. 60/583,609, filed Jun. 30, 2004, Alexandrov.
U.S. Appl. No. 60/583,691, filed Jun. 30, 2004, Alexandrov.
U.S. Appl. No. 60/612,891, filed Sep. 23, 2004, Kwok.
U.S. Appl. No. 60/637,140, filed Dec. 16, 2004, Feldman.
U.S. Appl. No. 60/757,544, filed Jan. 9, 2006, Dang.
U.S. Appl. No. 60/776,307, filed Feb. 24, 2006, Kwok.

(Continued)

*Primary Examiner* — Russell Kallis
(74) *Attorney, Agent, or Firm* — Fish & Richardson P.C.

(57) ABSTRACT

Materials and methods for identifying terpenoid regulatory region-regulatory protein associations are disclosed. Materials and methods for modulating expression of a sequence interest are also disclosed.

20 Claims, 201 Drawing Sheets

U.S. PATENT DOCUMENTS

| | | | |
|---|---|---|---|
| 6,835,540 | B2 | 12/2004 | Broun |
| 6,906,244 | B2 | 6/2005 | Fischer et al. |
| 7,173,121 | B2 | 2/2007 | Fang |
| 7,214,789 | B2 | 5/2007 | Pennell |
| 7,378,571 | B2 | 5/2008 | Apuya |
| 7,429,692 | B2 | 9/2008 | Dang |
| 2002/0023281 | A1 | 2/2002 | Gorlach et al. |
| 2002/0081731 | A1 | 6/2002 | Stafford et al. |
| 2002/0160378 | A1 | 10/2002 | Harper et al. |
| 2003/0037355 | A1 | 2/2003 | Barbas et al. |
| 2003/0061637 | A1 | 3/2003 | Jiang et al. |
| 2003/0093837 | A1 | 5/2003 | Keddie et al. |
| 2003/0121070 | A1 | 6/2003 | Adam et al. |
| 2003/0131386 | A1 | 7/2003 | Samaha et al. |
| 2003/0135887 | A1 | 7/2003 | Brandle et al. |
| 2003/0140381 | A1 | 7/2003 | Bate et al. |
| 2003/0150015 | A1 | 8/2003 | Norris et al. |
| 2003/0153097 | A1 | 8/2003 | Deshaies et al. |
| 2003/0170656 | A1 | 9/2003 | Cen et al. |
| 2003/0175783 | A1 | 9/2003 | Waterhouse et al. |
| 2003/0175965 | A1 | 9/2003 | Lowe et al. |
| 2003/0180945 | A1 | 9/2003 | Wang et al. |
| 2003/0226173 | A1 | 12/2003 | Ratcliffe et al. |
| 2003/0229915 | A1 | 12/2003 | Keddie et al. |
| 2004/0019925 | A1 | 1/2004 | Heard et al. |
| 2004/0019927 | A1 | 1/2004 | Sherman et al. |
| 2004/0034888 | A1 | 2/2004 | Liu et al. |
| 2004/0045049 | A1 | 3/2004 | Zhang et al. |
| 2004/0053876 | A1 | 3/2004 | Turner et al. |
| 2004/0072159 | A1 | 4/2004 | Takaiwa et al. |
| 2004/0078852 | A1 | 4/2004 | Thomashow et al. |
| 2004/0203109 | A1 | 10/2004 | Lal et al. |
| 2004/0214330 | A1 | 10/2004 | Waterhouse et al. |
| 2004/0216190 | A1 | 10/2004 | Kovalic |
| 2005/0009187 | A1 | 1/2005 | Shinozaki et al. |
| 2005/0081261 | A1 | 4/2005 | Pennell et al. |
| 2005/0108791 | A1 | 5/2005 | Edgerton et al. |
| 2005/0223434 | A1 | 10/2005 | Alexandrov et al. |
| 2005/0246785 | A1 | 11/2005 | Cook et al. |
| 2005/0257293 | A1 | 11/2005 | Mascia |
| 2006/0015970 | A1 | 1/2006 | Pennell et al. |
| 2006/0021083 | A1 | 1/2006 | Cook et al. |
| 2006/0041952 | A1 | 2/2006 | Cook et al. |
| 2006/0143729 | A1 | 6/2006 | Alexandrov et al. |
| 2006/0183137 | A1 | 8/2006 | Harper et al. |
| 2006/0194959 | A1 | 8/2006 | Alexandrov et al. |
| 2006/0195934 | A1 | 8/2006 | Apuya et al. |
| 2006/0272060 | A1 | 11/2006 | Heard et al. |
| 2007/0006335 | A1 | 1/2007 | Cook et al. |
| 2007/0016976 | A1 | 1/2007 | Katagiri et al. |
| 2007/0022495 | A1 | 1/2007 | Reuber et al. |
| 2007/0039067 | A1 | 2/2007 | Feldmann et al. |

FOREIGN PATENT DOCUMENTS

| | | |
|---|---|---|
| DE | 102 12 703 | 10/2003 |
| EP | 0 329 308 | 8/1989 |
| EP | 1 033 405 | 9/2000 |
| EP | 0 625 572 | 4/2001 |
| EP | 6 255 72 | 4/2001 |
| EP | 0 320 500 | 11/2004 |
| JP | 5-219974 | 8/1993 |
| JP | 09-224672 | 9/1997 |
| KR | 2004 008459 | 1/2004 |
| WO | 90/08828 | 8/1990 |
| WO | 95/35505 | 12/1995 |
| WO | 96/34981 | 11/1996 |
| WO | 96/36693 | 11/1996 |
| WO | 97/01952 | 1/1997 |
| WO | 97/31064 | 8/1997 |
| WO | 98/07842 | 2/1998 |
| WO | 98/36083 | 8/1998 |
| WO | 98/53083 | 11/1998 |
| WO | 99/04117 | 1/1999 |
| WO | 99/07865 | 2/1999 |
| WO | 99/24574 | 5/1999 |
| WO | 99/32619 | 7/1999 |
| WO | 99/34663 | 7/1999 |
| WO | 99/38977 | 8/1999 |
| WO | 99/53030 | 10/1999 |
| WO | 99/58723 | 11/1999 |
| WO | 00/34318 | 6/2000 |
| WO | 00/34319 | 6/2000 |
| WO | 00/34320 | 6/2000 |
| WO | 00/34321 | 6/2000 |
| WO | 00/34322 | 6/2000 |
| WO | 00/34323 | 6/2000 |
| WO | 00/34324 | 6/2000 |
| WO | 00/34325 | 6/2000 |
| WO | 00/34326 | 6/2000 |
| WO | 00/42200 | 7/2000 |
| WO | 00/46383 | 8/2000 |
| WO | 00/55174 | 9/2000 |
| WO | 01/35725 | 5/2001 |
| WO | 01/75164 | 11/2001 |
| WO | 02/15675 | 2/2002 |
| WO | 02/37111 | 5/2002 |
| WO | 02/46449 | 6/2002 |
| WO | 02/055536 | 7/2002 |
| WO | 02/055669 | 7/2002 |
| WO | 02/101052 | 12/2002 |
| WO | 03/013227 | 2/2003 |
| WO | 03/025172 | 3/2003 |
| WO | 03/034812 | 5/2003 |
| WO | 03/057877 | 7/2003 |
| WO | 03/060476 | 7/2003 |
| WO | 2004/027038 | 4/2004 |
| WO | 2004/035798 | 4/2004 |
| WO | 2004/039956 | 5/2004 |
| WO | 2004/041170 | 5/2004 |
| WO | 2004/043361 | 5/2004 |
| WO | 2005/023639 | 3/2005 |
| WO | 2005/034308 | 4/2005 |
| WO | 2005/047516 | 5/2005 |
| WO | 2005/054453 | 6/2005 |
| WO | 2006/005023 | 1/2006 |
| WO | 2006/009922 | 1/2006 |

OTHER PUBLICATIONS

Abler et al. "Isolation and characterization of a genomic sequence encoding the maize *Cat3* catalase gene" *Plant Mol. Biol.*, 22:1031-1038 (1993).

Ahn et al., "Homoeologous relationships of rice, wheat and maize chromosomes" *Molecular and General Genetics*, 241:483-490 (1993).

Albert et al., "Site-specific integration of DNA into wild-type and mutant lox sites placed in the plant genome," *Plant J.*, 1995, 7(4): 649-659.

Alexandrov et al. "Features of *Arabidopsis* genes and genome discovered using full-length cDNAs" *Plant Molecular Biology*, 60:69-85 (2006).

Allen et al. "RNAi-mediated replacement of morphine with the non-narcotic alkaloid reticuline in opium poppy" *Nature Biotechnology*, 22(12):1559-1566 (2004).

Alonso-Blanco et al., "The use of recombinant inbred lines (RILs) for genetic mapping," In Methods in Molecular Biology (J.M. Martinez-Zapater and J. Salinas, Humana Press, Totowa, NJ., 1998), 82: 137-146.

Armaleo et al., "Biolistic nuclear transformation of *Saccharomyces cerevisiae* and other fungi," *Current Genetics*, 1990, 17: 97-103.

Ausubel et al. Short Protocols in Molecular Biology 2nd Edition, Current Protocols in Molecular Biology, *Greene Publishing*, New York (1992), 54 pages.

Azpiroz-Leehan et al., "T-DNA insertion mutagenesis in *Arabidopsis*: going back and forth" Trends in Genetics, 13:152-156 (1997).

Baerson et al., "Developmental regulation of an acyl carrier protein gene promoter in vegetative and reproductive tissues" *Plant Mol. Biol.*, 22(2):255-267 (1993).

Bateman et al., "Pfam 3.1: 1313 multiple alignments and profile HMMs match the majority of proteins" *Nucl. Acids Res.*, 27(1):260-262 (1999).

BD Matchmaker, "One-Hybrid Library construction & Screening Kit," *Clonetechniques*, 2003, 2 pgs.

Bechtold et al., "In planta Agrobacterium mediated gene transfer by infiltration of adult Arabidopsis thaliana plants" C.R. Acad. Sci. Paris, 316:1194-1199 (1993).

Bird et al. "A tale of three cell types: alkaloid biosynthesis is localized to sieve elements in opium poppy" The Plant Cell, 15:2626-2635 (2003).

Biswas et al., "Transgenic indica rice (Oryza sativa L.) plants obtained by direct gene transfer to ptotoplasts," J. Biotechnol., 1994, 32: 1-10.

Blattner et al., "The complete genome sequence of Escherichia coli K-12" Science, 277:1453-1462 (1997).

Bonner et al., "Reduction in the rate of DNA reassociation by sequence divergence" J. Mol. Biol., 81:123-135 (1973).

Bradshaw et al., "A new vector for recombination-based cloning of large DNA fragments from yeast artificial chromosomes," Nucl. Acids. Rec., 1995, 23(23): 4850-4856.

Broun et al. "Catalytic plasticity of fatty acid modification enzymes underlying chemical diversity of plant lipids" Science, 282:1315-1317 (1998).

Brummell, et al., "Inverted repeat of a heterologous 3'-untranslated region for high-efficiency, high-throughput gene silencing" Plant J. 33:793-800 (2003).

Burke et al., "Cloning of large segments of exogenous DNA into yeast by means of artificial chromosome vectors," Science, 1987, 236: 806-812.

Burr et al., "Gene mapping with recombinant inbreds in maize," Genetics, 1988, 118: 519-526.

Burr et al., "Mapping Genes with Recombinant Inbreds," In Freeling Walbot (Ed.), The Maize Handbook, (New York, Springer-Verlag, 1994), pp. 249-254.

Busk et al., "Regulatory elements in vivo in the promoter of the abscisic acid responsive gene rab17 from maize" Plant Journal, 11(6):1285-1295 (1997).

Bustos et al., "Regulation of b-glucuronidase expression in transgenic tobacco plants by an A/T-rich, cis-acting sequence found upstream of a French bean b-phaseolin gene" Plant Cell, 1(9):839-854 (1989).

Carels et al., "Compositional properties of homologous coding sequences from plants" J. Mol. Evol., 46:45-53 (1998).

Casaretto et al. "The transcription factors HvABI5 and HvVP1 are required for the abscisic acid induction of gene expression in barley aleurone cells" The Plant Cell, 15:271-284 (2003).

Cerdan et al., "A 146 by fragment of the tobacco Lhcb1*2 promoter confers very-low-fluence and low-fluence and high-irradiance responses of phytochrom to a minimal CaMV 35S promoter" Plant Mol. Biol., 33:245-255 (1997).

Chang and Yang, "Enhancement of plant formation from embryo cultures of Taxus mairei using suitable culture medium and PCP," Bot. Bull. Acad. Sin., 1996, 37: 35-40.

Chang et al., "The Exo-gap method employing the phage f1 endonuclease generates a nested set of unidirectional deletions" Gene, 127:95-98 (1993).

Chen et al. "Expression profile matrix of Arabidopsis transcription factor genes suggests their putative functions in response to environmental stresses" The Plant Cell, 14:559-574 (2002).

Chen et al., "Functional analysis of regulatory elements in a plant embryo-specific gene" Proc. Natl. Acad. Sci. USA, 83:8560-8564 (1986).

Cheng et al., "Highly divergent methyltransferases catalyze a conserved reaction in tocopherol and plastoquinone synthesis in cyanobacteria and photosynthetic eukaryotes," Plant Cell, 2003, 15: 2343-2356.

Chenna et al., "Multiple sequence alignment with the Clustal series of programs" Nucleic Acids Res., 31(13):3497-3500 (2003).

Chinnusamy et al. "Screening for gene regulation mutants by bioluminescence imaging" Department of Plant Sciences, University of Arizona, Tucson, pp. 1-10 (2002).

Chitty et al., "Genetic transformation in commercial Tasmanian cultures of opium poppy, Papaver somniferum, and movement of transgenic pollen in the field," Funct. Plant Biol. 30:1045-1058 (2003).

Cho et al. "Expression of gamma-tocopherol methyltransferase transgene improves tocopherol composition in lettuce (Latuca sativa L.)" Molecules and Cells, 19(1):16-22 (2005).

Chou et al. "Enzymatic oxidation in the biosynthesis of complex alkaloids" The Plant Journal, 15(3):289-300 (1998).

Christou, "Strategies for variety-independent genetic transformation of important cereals, legumes and woody species utilizing particle bombardment" Euphytica, 85(1-3):13-27, (1995).

Collakova et al. "The role of homogentisate phytyltransferase and other tocopherol pathway enzymes in the regulation of tocopherol synthesis during abiotic stress" Plant Physiology, 133(2):930-940 (2003).

Conceicao, "A cotyledon regulatory region is responsible for the different spatial expression patterns of Arabidopsis 2S albumin genes" The Plant Journal, 1994, 5(4):493-505.

Conkling et al. "Isolation of transcriptionally regulated root-specific genes from tobacco" Plant Physiol., 93:1203-1211, (1990).

Cormack et al. "Leucine zipper-containing WRKY proteins widen the spectrum of immediate early elicitor-induced WRKY transcription factors in parsley" Biochimica et Biophysica Acta, 1572:92-100 (2002).

Cox et al., "Analysis of plant gene expression," In Plant Molecular Biology: A Practical Approach, (Shaw ed., IRL, Oxford, 1988), pp. 1-35.

Dai et al., "RF2b, a rice bZIP transcription activator, interacts with RF2a and is involved in symptom development of rice tungro disease" Proc. Natl. Acad. Sci. USA, 101(2):687-692 (2004).

de Feyter and Gaudron, Methods in Molecular Biology, vol. 74, Chapter 43, "Expressing Ribozymes in Plants", Edited by Turner, P.C., Humana Press Inc., Totowa, NJ, pp. 403-415.

De Martinis et al., "Silencing gene expression of the Ethylene-forming enzyme results in a reversible inhibition of ovule development in transgenic tobacco plants," The Plant Cell, 1999, 11: 1061-1071.

deVicente and Tanksley,"QTL analysis of transgressive segregation in an interspecific tomato cross," Genetics, 1993, 134: 585-596.

Dixon "A two-for-one in tomato nutritional enhancement" Nature Biotechnology, 23(7):825-826 (2005).

Doerks et al. "Protein annotation: detective work for function prediction" TIG, 14(6):248-250 (1998).

Dr. Duke's Phytochemical and ethnobotanical databases, obtained from the Internet on Feb. 9, 2005 at http://www.ars-grin.gov/cgi-bin/duke/farmacy2.pl, 7 pages.

Dupont et al., "The benzophenanthridine alkaloid fagaronine induces erythroleukemic cell differentiation by gene activation," Planta Med, 71(6):489-494 (2005).

Elegans et al. "Genome sequence of the nematode C. elegans: a platform for investigating biology" Science 282:2012-2018 (1998).

Escudero et al., "T-DNA transfer in meristematic cells of maize provided with intracellular Agrobacterium" Plant J., 10(2): 355-360 (1996).

Evans et al., Protoplasts Isolation and Culture in "Handbook of Plant Cell Culture," pp. 124-176, MacMillilan Publishing Company, New York, 1983.

Everett et al., "Pendred syndrome is caused by mutations in a putative sulphate transporter gene (PDS).," Nature Genetics, 1997, 17(4): 411-422.

Facchini "Alkaloid biosynthesis in plants: Biochemistry, cell biology, molecular regulation, and metabolic engineering applications" Annu. Rev. Plant Physiol. Plant Mol. Biol. 52:29-66 (2001).

Facchini et al., "Expression patterns conferred by tyrosine/dihydroxyphenylalanine decarboxylase promoters from opium poppy are conserved in transgenic tobacco" Plant Physiology, American Society of Plant Physiologists, vol. 118(1):69-81 (1998).

Fejes et al., "A 268 bp upstream sequence mediates the circadian clock-regulated transcription of the wheat Cab-1 gene in transgenic plants" Plant Mol. Biol., 15:921-932 (1990).

Fennoy et al. "Synonymous codon usage in Zea mays L. nuclear genes is varied by levels of C and G-ending codons" Nucleic Acids Research, 21(23):5294-5300 (1993).

Frischauf et al., "Lambda replacement vectors carrying polylinker sequences," J. Mol. Biol., 1983, 170: 827-842.

Fromm et al. "Expression of genes transferred into monocot and dicot plant cells by electroporation" *Proc. Natl. Acad. Sci. USA*, 82:5824-5828 (1985).
Fromm et al., "An octopine synthase enhancer element directs tissue-specific expression and binds ASF-1, a factor from tobacco nuclear extracts" *The Plant Cell*, 1:977-984 (1989).
Fry et al., "A new approach to template purification for sequencing applications using paramagnetic particles" *Biotechniques*, 13: 124-131 (1992).
Galweller et al. , "The DNA-binding activity of Gal4 is inhibited by Methylation of the Gal4 binding site in plant chromatin" *The Plant Journal*, 23(1):143-157 (2000).
Gardiner et al., "Development of a core RFLP map in maize using an immortalized F2 population," *Genetics*, 1993, 134: 917-930.
GenBank Accession No. AAC08528, dated Mar. 31, 1998, 2 pages.
GenBank Accession No. AAB57606, dated May 14, 1997, 1 page.
GenBank Accession No. AAK25859, dated Sep. 18, 2002, 2 pages.
GenBank Accession No. AAL06888, dated Sep. 30, 2001, 2 pages.
GenBank Accession No. AAM63077, dated Jan. 27, 2006, 2 pages.
GenBank Accession No. AAM67014, dated Jan. 27, 2006, 2 pages.
GenBank Accession No. AAN13094, dated Sep. 23, 2002, 2 pages.
GenBank Accession No. ABF85788, dated Jun. 7, 2006, 2 pages.
GenBank Accession No. AF000657, dated Oct. 7, 1997, 27 pages.
GenBank Accession No. AF096096, dated Jan. 25, 1999, 2 pages.
GenBank Accession No. AF129516, dated Apr. 6, 1999, 2 pages.
GenBank Accession No. BAB09004, dated Feb. 14, 2004, 2 pages.
GenBank Accession No. BAB62076, dated Feb. 14, 2004, 2 pages.
GenBank Accession No. CAB87794, dated Nov. 15, 2006, 2 pages.
GenBank Accession No. L05934, dated Oct. 22, 1993, 3 pages.
GenBank Accession No. NP 191900, dated Apr. 20, 2007, 2 pages.
GenBank Accession No. NP 200968, dated Apr. 20, 2007, 2 pages.
GenBank Accession No. NP_564186, dated Feb. 23, 2005, 2 pages.
GenBank Accession No. U93215, dated Feb. 27, 2002, 42 pages.
Bevan et al., PIR Accession No. T05752 (UniProt Accession No. 081831 (Nov. 1, 1998)), 3 pages.
Ghosh et al. "Trangenic Indica rice (*Oryza sativa* L.) plants obtained by direct gene transfer to protoplasts" *J. Biotechnol.*, 32:1-10 (1994).
Gilmour et al. "Low temperature regulation of the *Arabidopsis* CBF family of AP2 transcriptional activators as an early step in cold-induced *COR* gene expression" *Plant Journal*, 16(4):433-442 (1998).
Gleave, AP., "A versatile binary vector system with a T-DNA organizational structure conducive to efficient integration of cloned DnA into the plant genome" Plant Mol. Biol. 20:1203-1207 (1992).
Golovkin et al., "An SC35-like protein and a novel serine/arginine-rich protein interact with *Arabidopsis* U1-70K protein" *J. Biol. Chem.* 274(51):36428-36438, (1999).
Gould et al., "Transformation of *Zea mays* L. Using *Agrobacterium tummefaciens* and the shoot apex" *Plant Physiology*, 95:426-434 (1991).
Graves and Goldman, "The transformation of *Zea mays* seedling with *Agrobacterium tumefaciens*" Plant Mol. Biol., 7:43-50 (1986).
Grec et al., "Identification of regulatory sequence elements within the transcription promoter region of npABC1, a gene encoding a plant ABC transporter induced by diterpenes," *The Plant Journal*, 2003, vol. 35, pp. 237-250.
Green et al., "Binding site requirements for pea nuclear protein factor GT-1 correlate with sequences required for light-dependent transcriptional activation of the *rbcS-3A* gene" *EMBO J.*, 7:4035-4044 (1988).
Guilfoyle, "Ligation-mediated PCR amplification of specific fragments from a class-II restriction endonuclease total digest" *Nucleic Acids Res.*, 25(9): 1854-1858 (1997).
Hamilton et al., "Stable transfer of intact high molecular weight DNA into plant chromosomes," *Proc. Natl. Acad. Sci.*, USA, 1996, 93: 9975-9979.
Hamilton et al., "Antisense gene that inhibits synthesis of the hormone ethylene in transgenic plants" *Nature*, 346:284-287 (1990).
Hamilton, "A binary-BAC system for plant transformation with high-molecular-weight DNA" *Gene*, 200:107-116 (1997).
Hannappel et al., "The thymosins. Prothymosin alpha, parathymosin, and beta-thymosins: structure and function," *Vitamins & Hormones*, 2003, 66: 257-296.

Hannenhalli et al. "Promoter prediction in the human genome" *Bioinformatics*, 17:S90-S96 (2001).
Haralampidis et al. "A new class of oxidosqualene cyclases directs synthesis of antimicrobial phytoprotectants in monocots" *Proc. Natl. Acad. Sci. USA*, 98(23):13431-13436 (2001).
Haseloff et al. "Simple RNA enzymes with new and highly specific endoribonuclease activities" *Nature*, 334: 585-591 (1988).
Hauschild et al. "Isolation and analysis of the gene bbe1 encoding the berberine bridge enzyme from the California poppy *Eschscholzia californica*" Plant Molec. Biol., 36:473-478 (1998).
Hellens et al. "Transient expression vectors for functional genomics, quantification of promoter activity and RNA silencing in plants" *Plant Methods*, 1 (13): 14 pages (2005).
Herrera et al. "Cloning and characterization of the *Arabidopsis thaliana* lupeol synthase gene" *Phytochemistry*, 49(7):1905-1911 (1998).
Herrera-Estrella et al., "Chimeric genes as dominant selectable markers in plant cells" *EMBO J.*, 2(6):987-995 (1983).
Hilbricht et al. "CpR18, a novel SAP-domain plant transcription factor, binds to a promoter region necessary for ABA mediated expression of the *CDeT27-45* gene from the resurrection plant *Craterostigma plantagineum* Hochst" *The Plant Journal*, 31(3):293-303 (2002).
Hong et al., "Promoter sequences from two difference *Brassica napus* tapetal oleosin-like genes direct tapetal expression β-glucuronidase in transgenic *Brassica* plants" *Plant Mol Biol.*, 1997 34(3):549-555.
Hosoyama et al. "Oryzacystatin exogenously introduced into protoplasts and regeneration of transgenic rice" *Biosci. Biotechnol. Biochem.* 58(8): 1500-1505 (1994).
Hu et al., "*Escherichia coli* one-and two-hybrid systems for the analysis and identification of protein-protein interactions," *Methods*, 2000, 20: 80-94.
Husselstein-Muller et al. "Molecular cloning and expression in yeast of 2,3-oxidosqualene-triterpenoid cyclases from *Arabidopsis thaliana*" *Plant Mol. Biol.*, 45(1):75-92 (2001).
Huynh et al., In Glover NM (ed) DNA Cloning: A practical approach, vol. 1 (Oxford, IRL Press, 1985) , pp. 49-78.
Hwang et al, "Aleurone- and embryo-specific expression of the β-glucuronidase gene controlled by the barley *Chi26* and *Ltp1* promoters in transgenic rice" *Plant Cell Rep*, 20(7):647-654 (2001).
Hwang et al. "An *Arabidopsis thaliana* root-specific kinase homolog is induced by dehydration, ABA, and NaC1" *The Plant Journal*, 8(1):37-43 (1995).
Hyrup et al., Peptide nucleic acids (PNA): synthesis, properties and potential applications *Bioorgan. Med. Chem.*, 4:5-23 (1996).
Ichimura et al., "Isolation of ATMEKK1 (a MAP Kinase Kinase Kinase)-interacting proteins and analysis of a MAP Kinase cascade in *Arabidopsis*" *Biochim. Biophys. Res. Comm.* 253:532-543, (1998).
Ishida et al., "High efficiency transformation of maize (*Zea mays* L. mediated by *Agrobacterium tumefaciens*" *Nature Biotechnology*, 14:745-750 (1996).
Jakoby et al. "bZIP transcription factors in *Arabidopsis*" *Trends in Plant Science*, 7(3):106-111 (2002).
Joh et al. "High-level transient expression of recombinant protein in lettuce" *Biotechnology and Bioengineering*, 91(7):861-871 (2002).
Jordano et al., "A sunflower helianthinin gene upstream sequence ensemble contains an enhancer and sites of nuclear protein interaction" *Plant Cell*, 1:855-866 (1989).
Kanwischer et al. "Alterations in tocopherol cyclase activity in transgenic and mutant plants of *Arabidopsis* affect tocopherol content, tocopherol composition, and oxidative stress" *Plant Physiology*, 137:713-723 (2005).
Kato et al., "Construction of a human full-length cDNA bank" *Gene* 150:243-250 (1994).
Keegstra and Cline, "Protein import and routing systems of chloroplasts," *The Plant Cell*, 1999, 11: 577-570.
Keller and Baumgartner, "Vascular-specific expression of the bean GRP 1.8 gene is negatively regulated" *Plant Cell*, 3(10):1051-1061 (1991).

Keller and Manak "DNA Probes Section One: Molecular Hybridization Technology", 2nd Ed. c. 1993 by Stockton Press, New York, NY, pp. 1-25.

Kim et al. "A 20 nucleotide upstream element is essential for the nopaline synthase (nos) promoter activity" *Plant Molecular Biology*, 1994, 24:105-117.

Klee et al. "Agrobacterium-mediated plant transformation and its further applications to plant biology" *Ann. Rev. of Plant Phys.*, 38:467-486 (1987).

Klein et al., "High-velocity microprojectiles for delivering nucleic acids into living cells," *Nature*, 1987, 327: 70-73.

Kohler and Milstein "Continuous cultures of fused cells secreting antibody of predefined specificity" *Nature*, 256: 495-497 (1975).

Koltonow et al., "Different temporal and spatial gene expression patterns occur during anther development" *Plant Cell*, 2:1201-1224 (1990).

Komari et al., "Vectors carrying two separate T-DNAs for co-transformation of higher plants mediated by *Agrobacterium tumefaciens* and segregation of transformants free from selection markers" *Plant J.*, 10(1): 165-174 (1996).

Kotani et al., Structural Analysis of *Arabidopsis thaliana* chromosome 5. VI. Sequence features of the Regions of 1,367,185 bp covered by 19 physically assigned P1 and TAC clones, *DNA Research*, 1998, 5: 203-216.

Kuhlmann et al. "α-Helical D1 domain of the tobacco bZIP transcription factor BZI-1 interacts with the ankyrin-repeat protein ANK1 and is important for BZI-1 function, both in auxin signaling and pathogen response" *The Journal of Biological Chemistry*, 278(10) 8786-8794 (2003).

Kushiro et al. "Beta-Amyrin synthase: Cloning of oxidosqualene cyclase that catalyzes the formation of the most popular triterpene among higher plants" *European Journal of Biochemistry*, 256:238-244 (1998).

Kutchan "Molecular genetics of plant alkaloid biosynthesis" *The Alkaloids*, 50:257-316 (1998).

Lam et al., "Site-specific mutations in alter in vitro factor binding and change promoter expression pattern in transgenic plants" *Proc. Natl. Acad. Sci. USA*, 86:7890-7894 (1989).

Lee et al., "A C-methyltransferase involved in both ubiquinone and menaquinone biosynthesis: isolation and identification of the *Escherichia coli* ubiE gene" *J. Bacteriol*. 179:1748-1754 (1997).

Li et al., "Generation of destabilized green fluorescent protein as a transcription reporter" *J. Biol. Chem.* 273(52):34970-34975 (1998).

Liljegren, "Interactions among *APETALA1, Leafy*, and *Terminal Flower1* specify meristem fate" *Plant Cell*, 11:1007-1018 (1999).

Liu et al. "Two transcription factors, DREB1 and DREB2, with an EREBP/AP2 binding domain separate two cellular signal transduction pathways in drought- and low-temperature-responsive gene expression, respectively, in *Arabidopsis*" *The Plant Cell*, 10:1391-1406 (1998).

Hwang et al., "Aleurone- and embryo-specific expression of the B-glucuronidase gene controlled by the barley *Chi26* and *Ltp1* promoters in transgenic rice," *Plant Cell Rep*. 2001, 20: 647-654.

Lu et al. "Three novel MYB proteins with one DNA binding repeat mediate sugar and hormone regulation of α-amylase gene expression" *The Plant Cell*, 14:1963-1980 (2002).

Luan et al., "A rice *cab* gene promoter contains separate *cis*-acting elements that regulate expression in dicot and monocot plants" *The Plant Cell*, 4:971-981 (1992).

Lubberstedt et al., "Promoters from genes for plastid proteins possess regions with different sensitivities toward red and blue light" *Plant Physiol.*, 104:997-1006 (1994).

Luo et al., "Mapping sequence specific DNA-protein interactions: A versatile, quantitative method and its application to transcription factor XF1," *J. Mo.. Biol.*, 1997, 266: 479-492.

Macleod et al., Expression of antisense to DNA methyltransferase mRNA induces DNA demethylation and inhibits tumorigenesis, *J. Biological Chemistry*, vol. 270(14): 8037-8043, (1995).

Mariani et al., "A chimaeric ribonuclease-inhibitor gene restores fertility to male sterile plants" *Nature*, 357: 384-387 (1992).

Mariconti et al. "The E2F family of transcription factors from *Arabidopsis thaliana*" *The Journal of Biological Chemistry*, 277(12):9911-9919 (2002).

Marra et al., "High throughput fingerprint analysis of large-insert clones," *Genomic Research*, 1997, 7: 1072-1084.

Martinez et al., "Creating of ecdysone receptor chimeras in plants for controlled regulation of gene expression," *Mol. Gen. Genet.*, 1999, 261: 546-552.

Marty, "Plant Vacuoles," *The Plant Cell*, 1999, 11: 587-599.

Maruyama et al., "Oligo-capping: a simple method to replace the cap structure of eukaryotic mRNAs with oligoribonucleotides" *Gene* 138:171-174 (1994).

Matsuoka et al., "Tissue-specific light-regulated expression directed by the promoter of a C4 gene, maize pyruvate, orthophosphate dikinase, in a C3 plant, rice" *Proc. Natl. Acad. Sci. USA*, 90:9586-9590 (1993).

Matteucci et al. "Synthesis of Deoxyoligonucleotides on a polymer support" *J. Am. Chem. Soc.*, 103:3185-3191 (1981).

May et al., "Generation of transgenic banana (*Musa acuminate*) plants via *Agrobacterium*-mediated transformation" *Bio/Technology*, 13:486-492 (1995).

McAlister-Henn et al., "Application of the yeast two-hybrid system," *Methods*, 1999, 19: 330-337.

McCormac et al., "A flexible series of binary vectors for *Agrobacterium*-mediated plant transformation" *Mol. Biotechnol.*, 8:199-213 (1997).

Medberry et al., "The Commelina yellow mottle virus promoter is a strong promoter in vascular and reproductive tissues" *Plant Cell*, 4(2):185-192 (1992).

Meier et al., "Elicitor-inducible and constitutive in vivo DNA footprints indicate novel *cis*-acting elements in the promoter of a parsley gene encoding pathogenesis-related protein 1" *Plant Cell*, 3:309-316 (1991).

Memelink "Putting the opium in poppy to sleep" *Nature Biotechnology*, 2004, 22(12):1526-1527.

Menke et al. "A novel jasmonate- and elicitor-responsive element in the periwinkle secondary metabolite biosynthetic gene *Str* interacts with a jasmonate- and elicitor-inducible AP2-domain transcription factor, ORCA2" *The EMBO Journal*, 18(16):4455-4463 (1999).

Michaels et al., "Flowering locus C encodes a novel MADS domain protein that acts as a repressor of flowering," *The Plant Cell*, 1999, 11: 949-956.

Motohashi et al. "Functional analysis of the 37 kDa inner envelope membrane polypeptide in choloroplast biogenesis using a Ds-tagged *Arabidopsis* pale-green mutant" *The Plant Journal*, 34(5):719-731 (2003).

Müller et al., "High meiotic stability of a foreign gene introduced into tobacco by *Agrobacterium*-mediated transformation" *Mol. Gen. Genet.*, 207:171-175 (1987).

Mushegian and Koonin, "Sequence analysis of eukaryotic development proteins: ancient and novel domains," *Genetics*, 1996, 144: 817-828.

Napoli et al., "Introduction of a chimeric chalcone synthase gene into petunia results in reversible co-suppression of homologous genes in trans." *The Plant Cell*, 2:279-289 (1990).

Needleman and Wunsch "A general method applicable to the search for similarities in the amino acid sequence of two proteins" *J. Mol. Biol.*, 48:443-453 (1970).

Niu et al., "Factors affecting *Agrobacerium tumefaciens*-mediated transformation of peppermint," *Plant Cell Rep.*, 2000, 19:304-310.

Oeller et al., "Reversible inhibition of tomato fruit senescence by antisense RNA" *Science*, 254:437-439 (1991).

Ohme-takagi and Shinshi, "Ethylene-inducible DNA binding proteins that interact with an ethylene-responsive element," *Plant Cell*, 1995, 7: 173-182.

Ounaroon et al. "(R, S)-Reticuline 7-O-methyltrasnferase and (R, S)-norcoclaurine 6-O-methyltransferase of *Papaver somniferum*—cDNA cloning and characterization of methyl transfer enzymes of alkaloid biosynthesis in opium poppy" *The Plant Journal*, 36(6):808-819 (2003).

Panaud et al., "Frequency of microsatellite sequences in rice (*Oryza sative* L.)," *Genome*, 1995, 38: 1170-1176.

Park & Facchini, "*Agrobacterium*-mediated genetic transformation of California poppy, *Eschscholzia californica* Cham., via somatic embryogenesis" *Plant Cell Rep.* 19: 1006-1012, (2000).

Park & Facchini, "High-efficiency somatic embryogenesis and plant regeneration in California poppy, *Eschscholzi califronica* Cham." *Plant Cell Rep* 19: 421-426, (2000).

Park et al., "*Agrobacterium* rhizogenes-mediated transformation of opium poppy, *Papaver somniferum* L., and California poppy, *Eschscholzia californica* Cham., root cultures" *J. Exp. Botany*, 2000, 51(347):1005-1016.

Park et al., "Analysis of promoters from tyrosine/dihydroxyphenylalanine decarboxylase and berberine bridge enzyme genes involved in benzylisoquinoline alkaloid biosynthesis in opium poppy" *Plant Molecular Biology*, 40(1):121-131 (1999).

Park et al., "Efficient and genotype-independent *Agrobacterium*—mediated tomato transformation," *J. Plant Physiol.*, 2003, 160:1253-1257.

Pasquali et al. "Coordinated regulation of two indole alkaloid biosynthetic genes from catharanthus-roseus by auxin and elicitors" *Plant Molecular Biology*, 18(16):1121-1131 (1992).

Paszkowski et al. "Direct gene transfer to plants" *EMBO J.*, 3:2717-2722 (1984).

Pauli et al., "Molecular cloning and functional heterologous expression of two allels encoding (S)-N-Methylcoclautine 3'-hydroxylase (CYP80B1), Anew methyl jasmonate-inducible cytochrome P-450-Dependent Mono-Oxygenase of benyzlisoquinoline alkaloid biosynthesis," *Plant Journal*, Blackwell Scientific Publications, Oxford, GB, 1998, 13(6): 793-801.

Pearson and Lipman "Improved tools for biological sequence comparison" *Proc. Natl. Acad. Sci. USA*, 85: 2444-2448 (1988).

Perriman et al., "Effective ribozyme delivery in plant cells" Proc. Natl. Acad. Sci. USA, 92(13):6175-6179 (1995).

Pollock et al. "Human SRF-related proteins: DNA-binding properties and potential regulatory targets" *Genes and Development*, 12A:2327-2341 (1991).

Potenza et al. "Invited review: Targeting transgene expression in research, agricultural, and environmental applications: Promoters used in plant transformation" *In Vitro Cellular and Developmental Biology*, 2004, 40(1):1-22.

Refseth et al., "Hybridization capture of microsatellites directly from genomic DNA" *Electrophoresis*, 18:1519-1523 (1997).

Riechmann et al. "*Arabidopsis* transcription factors: genome-wide comparative analysis among eukaryotes" *Science*, 290:2105-2110 (2000).

Riggs et al., "Cotyledon nuclear proteins bind to DNA fragments harboring regulatory elements of phytohemagglutinin genes" *Plant Cell*, 1(6):609-621 (1989).

Rivera et al, "Genomic evidence for two functionally distinct gene classes" *Proc. Natl. Acad. Sci. USA*, 95:6239-6244 (1998).

Rogers, S. G. et al., "Gene transfer in plants: production of transformed plants using ti plasmid vectors" *Methods in Enzymology*, 1987, 118: 627-684.

Roulet et al. "Evaluation of computer tools for the prediction of transcription factor binding sites on genomic DNA" obtained from the internet on Aug. 6, 2004 at http://www.bioinfo.de/isb/1998/01/0004/main.html, 7 pages.

Salomon et al., "Genetic identification of functions of TR-DNA transcripts in octopine crown galls" *EMBO J.*, 3:141-146 (1984).

Sambrook et al., 1989, "Molecular Cloning, A Laboratory Manual", second edition, *Cold Spring Harbor Press*, Plainview; NY, 21 pages.

Sattler et al., "GM technology series: from *Arabidopsis* to agriculture: engineering improved vitamin E content in soybean," *Trends in Plant Science*, 2004, 19(8): 365-367.

Schwartz et al., "The basic region of myogenin cooperates with two transcription activation domains to induce muscle-specific transcription," *Mol. Cell. Biol.*, 1992, 12: 266-275.

Scott et al., "The pendred syndrome gene encodes a chloride-iodide transport protein," *Nature Genetics*, 1999, 21: 441-443.

Seki et al., "Hig-efficiency cloning of *Arabidopsis* full-length cDNA by biotinylated CAP trapper" Plant Journal 15(5): 707-720 (1998).

Smith and Waterman, "Comparison of Biosequences" Advances in Applied Mathematics., 2:482-489 (1981).

Sheehy et al., "Reduction of polygalacturonase activity in tomato fruit by antisense RNA" Proc. *Nat. Acad. Sci. USA*, 85:8805-8809 (1988).

Sheridan, "The *mac1* Gene: Controlling the commitment to the meiotic pathway in Maize" *Genetics*, 142:1009-1020 (1996).

Shintani et al. "Elevating the vitamin E content of plants through metabolic engineering" *Science*, 282(5396):2098-2100 (1998).

Shizuya et al., "Cloning and stable maintenance of 300-kilobase-pair fragments of human DNA in *Escherichia coli* using an F-factor-based vector," *Proc. Natl. Acad. Sci*, USA, 1992, 89: 8794-8797.

Slocombe et al., "Temporal and tissue-specific regulation of a *Brassica napus* stearoyl-acyl carrier protein desaturase gene" *Plant Physiol.*, 104(4):1167-1176 (1994).

Sonnhammer et al., "Pfam: A comprehensive database of protein domain families based on seed alignments" *Proteins*, 28:405-420 (1997).

Sonnhammer et al., "Pfam: multiple sequence alignments and HMM-profiles of protein domains" *Nucl. Acids Res.*, 26:320-322 (1998).

Sternberg et al., "Bacteriophage P1 cloning system for the isolation, amplification, and recovery of DNA fragments as large as 100 kilobase pairs," *Proc. Natl. Acad. Sci. USA*, 1990, 87(1): 103-107.

Stockinger et al. "*Arabidopsis thaliana* CBF1 encodes an AP2 domain-containing transcriptional activator that binds to the C-repeat/DRE, a cis-acting DNA regulatory element that stimulates transcription in response to low temperature and water deficit" *Proc. Natl. Acad. Sci. USA*, 94:1035-1040 (1997).

Summerton and Weller, "Morpholino antisense oligomers: design, preparation, and properties" *Antisense Nucleic Acid Drug Dev.*, 7:187-195 (1997).

Tanksley and McCouch, "Seed banks and molecular maps: Unlocking genetic potential from the wild," *Science*, 1997, 277: 1063-1066.

Taramino et al., "Simple sequence repeats for germplasm analysis and mapping in maize," *Genome*, 1996, 39(2): 277-287.

Tijessen, "Hybridization with Nucleic Acid Probes" in Laboratory Techniques in Biochemistry and Molecular Biology, P.C. vand der Vliet, ed., c. 1993 by Elsevier, Amsterdam, pp. 19-78.

Truernit et al., "The promoter of the *Arabidopsis thaliana* SUC2 sucrose-H$^+$ symporter gene directs expression of β-glucuronidase to the phloem: Evidence for phloem loading and unloading by SUC2" *Planta*. 196:564-570 (1995).

Ulmasov et al. "ARF1, a transcription factor that binds to auxin response elements" *Science*, 276:1865-1868 (1997).

Urao et al. "Molecular cloning and characterization of a gene that encodes a MYC-related protein in *Arabidopsis*" *Plant Mol. Biol.*, 32:571-57 (1996).

Urdea et al. "Chemical synthesis of a gene for human epidermal growth factor urogastrone and its expression in yeast" *Proc. Natl. Acad. Sci. USA*, 80:7461-7465 (1983).

Valentin et al., "The *Arabidopsis* vitamin E pathway gene5-1 mutant reveals a critical role for Phytolkinase in seed tocopherol biosynthesis," *The Plant Cell*, 2006, 18(1): 212-224.

Van der Fits et al. "The jasmonate-inducible AP2/ERF-domain transcription factor ORCA3 activates gene expression via interaction with a jasmonate-responsive promoter element" *The Plant Journal*, 25(1):43-53 (2001).

van der Krol et al., "Flavonoid genes in petunia: Addition of a limited number of gene copies may lead to a suppression of gene expression" *The Plant Cell*, 2:291-299 (1990).

Van Eenennaam et al. "Elevation of seed α-tocopherol levels using plant-based transcription factors targeted to an endogenous locus" *Metab. Eng.*, 6(2):101-108 (2004).

Vaucheret et al., "Transgene-induced gene silencing in plants," *The Plant Journal*, 1998, 16(6): 651-669.

Venkateswarlu et al., "Evidence for T-DNA mediated gene targeting to tobacco chloroplasts" *Biotechnology*, 9:1103-1105 (1991).

Vitale and Denecke, "The endoplasmic reticulum-gateway of the secretory pathway," The Plant Cell, 1999, 11: 615-628.

Vergunst et al., "Cre/*lox*-mediated site-specific integration of *Agrobacterium* T-DNA in *Arabidopsis thaliana* by transient expression of *cre*," Plant Mol. Biol., 38: 393-406 (1998).

Vergunst et al., "Site-specific integration of *Agrobacterium* T-DNA in *Arabidopsis thaliana* mediated by Cre recombinase" *Nucleic Acids Res.*, 26(11): 2729-2734 (1998).

Verpoorte et al. "Engineering secondary metabolite production in plants" *Current Opinion in Biotechnology*, 13(2):181-187 (2002).

Vitale and Denecke, "The endoplasmic reticulum-gateway of the secretory pathway," *The Plant Cell*, 1999, 11: 615-628.

Walden et al., "A novel 205-kilodalton testis-specific serine/threonine protein kinase associated with microtubules of the spermatid manchette," *Mol. Cell Biol.*, 1993, 13(12): 7625-7635.

Weber et al., "In vitro DNA methylation inhibits gene expression in transgenic tobacco," *The EMBO Journal*, Dec. 1990, 9(13): 4409-4415.

Weigel D, "The APETALA2 domain is related to a novel type of DNA binding domain" *Plant Cell*, 7:388-389 (1995).

Weising et al., "Foreign genes in plants: transfer, structure, expression, and applications" *Ann. Rev. Genet.*, 22:421-477 (1988).

Williams et al., "Development of a PCR-based allele-specific assay from an RFLP probe linked to resistance to cereal cyst nematode in wheat" *Genome*, 39: 798-801 (1996).

Wroblewski et al. "Optimization of *Agrobacterium*-mediated transient assays of gene expression in lettuce, tomato and *Arabidopsis*" *Plant Biotechnology Journal*, 3:259-273 (2005).

Xiong et al. "Repression of stress-responsive genes by FIERY2, a novel transcriptional regulator in *Arabidopsis*" *Proc. Natl. Acad. Sci. USA*, 99(16)10899-10904 (2002).

Xu et al. "Characterization of a rice gene family encoding root-specific proteins" Plant Mol. Biol., 27:237-248 (1995).

Yamamoto et al., "Characterization of *cis*-acting sequences regulating root-specific gene expression in tobacco" *The Plant Cell*, 3:371-382 (1991).

Yamamoto et al., "The promoter of a pine photosynthetic gene allows expression of a β-glucuronidase reporter gene in transgenic rice plants in a light-independent but tissue-specific manner" *Plant Cell Physiol.*, 1994, 35:773-778.

Yanagisawa "Transcription factors in plants: physiological functions and regulation of expression" *J. Plant Res.*, 111:363-371 (1998).

Yanagisawa et al., "Metabolic engineering with Dof1 transcription factor in plants: Improved nitrogen assimilation and growth under low-nitrogen conditions" *Proc. Natl. Acad. Sci. USA*, 101(20):7833-7838 (2004).

Yanagisawa, "The Dof family of plant transcription factors" *Trends in Plant Science*, 7(12):555-560 (2002).

Zhang et al. "Metabolic engineering of tropane alkaloid biosynthesis in plants" *Journal of Integrative Plant Biology*, 47(2):136-143 (2005).

Zhang et al., "DNA sequences that activate isocitrate lyase gene expression during late embryogenesis and during postgerminative growth," *Plant Physiology*, 110:1069-1079 (1996).

Zheng et al., "*SPK1* is an Essential S-Phase-Specific Gene of *Saccharomyces cerevisiae* that encodes a nuclear serine/threonine/tyrosine kinase" *Mol. Cell Biol.*, 1993, 13:5829-5842.

\* cited by examiner

Figure 1 (Continued)

```
CeresClone:480672       SAAPPKLKTM  KSNDATRDK  IREILHEALS   KVTGEADED-              226
Lead-cDNA-ID23480178    ANAPPKLTAM  LKCNDPVRDK  RELLVEALC    RVAGEADDYE              236
gi|50919393             PNGPPKLTSL  VKCNDPTRDK  IRELLADAFS   RVHCETSKDD              225
CeresClone:245039       PNGHPKLTSL  VKCNDPTRDK  RELLAEAFV    RVSRETSDDD  REEVRNILDE  226
CeresClone:229156       PNGHPKLTSL  VKCNDPTRDK  RELLAEAFV    SVSRETSDDD  RDEVRNILDE  226
                                                                        RDEVKNILDE
Consensus               PNGPPKLTSM  VKCNDPTRDK  IRELLAEAF-   RVSGETSDDD  RDEVRNILDE  250

CeresClone:480672       VNNSDPLRVA  VTVESVLFEK  WGPSNGAQKV   KYRSLMFNLK              276
Lead-cDNA-ID23480178    VNASDPLRVA  VSVESLMFEK  LGRSTGAQKL   KYRSIMFNLR              286
gi|50919393             VDARDPFRVA  VTVESALFER  LGRSTGAHKA   KYRSIMFNLR              275
CeresClone:245039       VEARDPYRVA  VTVESALFER  LGPSTGTHRA   KYRSIMFNLR              276
CeresClone:229156       VEACDPYRVA  VTVESALFER  LGPSTGTHRA   KYRSIMFNLR              276
Consensus               V-A-DPYRVA  VTVESALFER  LGPSTGAHKA   KYRSIMFNLR  AENNTDFRRR  300

CeresClone:480672       VLLGVIEPEQ  LINMSTAEMA  SEQRKQEYQK   IEKALFECE   RGGPPKATTD  326
Lead-cDNA-ID23480178    VLTGEISPEK  LITLSAEDMA  SDKRKQENNQ   KEKALFDCE   RGLAAKASTD  336
gi|50919393             VLLGQVRPER  LVDISPEEMA  SDARKLENKQ   KEKALFDCE   RGAPKATTD   325
CeresClone:245039       VLIGLVAPER  LPDVSPDEMA  SDARKQENMQ   KEKALFDCE   RGAAPKATTD  326
CeresClone:229156       VLIGLVAPER  LPDISPDEMA  SDARKQENMQ   KEKALFDCE   RGAAPKATTD  326
Consensus               VL-GLVAPER  LVDISP-EMA  SDARKQEN--Q  IKEKALFDCE  RG-APKATTD  350

CeresClone:480672       QFKCGRCGQR  KTTYYQMQTR  SADEPMTTYV   TCVCNNRWK   FC          368
Lead-cDNA-ID23480178    QFKCGRCGQR  KCTYYQMQTR  SADEPMTTFYV  TCVNCDNHWK  FC          378
gi|50919393             QFKCGRCGQR  KTTYYQLQTR  SADEPMTTFV   TCVNCNNHWK  FC          367
CeresClone:245039       QFKCARCGQR  KTTYYQLQTR  SADEPMTTFV   TCVNCNNHWK  FC          368
CeresClone:229156       QFKCARCGQR  KTTYYQLQTR  SADEPMTTFV   TCVNCNNHWK  FC          368
Consensus               QFKCGRCGQR  KTTYYQMQTR  SADEPMTTFV   TCVNCNNHWK  FC          392
```

Figure 2

| | | | | | |
|---|---|---|---|---|---|
| Lead-cDNA-ID23492765 | -MANSMAT LS | RRLY---RSLL | SNPL-RI SQAS | MSFCTNNI TS | PEDSDFDELE | 46
| CeresClone:381106 | MAASSASLLA | RRLIMSRRFL | SSPLGSLSTT | ITTRSFSISS | PGFKSFV-VE | 49
| gi\|55297106 | MAATASSFLA | RRLLLTRRVL | SSPLRPFSTT | DSSSSSSSSS | SDDDSRAGSD | 50
| gi\|34911652 | MAATASSFLA | RRLLLTRRVL | SSPLRPFSTT | DSSSSSSSSS | SDDDSRAGSD | 50
| Consensus | MAAT-SSFLA | RRLLLTRRVL | SSPLRPFSTT | DSSSSSS-SS | -SDDS-AG-- | 50

| Lead-cDNA-ID23492765 | SPI EPKASDP | VS----RFS | CEERVME-ER | PLENGLDSGI | FKAI LVGQVG | 90
| CeresClone:381106 | SDLENEQDQR | PADQNRQQTS | NSPRPPDTTR | PLENGLDPGI | YKAI LVGKVG | 99
| gi\|55297106 | AGPDPEQQQP | PPAGQDQQAA | ARPRAGD-TR | PLENGLDPGI | YKAI MVGKVG | 99
| gi\|34911652 | AGPDPEQQQP | PPAGQDQQAA | ARPRAGD-TR | PLENGLDPGI | YK-----VG | 93
| Consensus | -G---PEQQQP | P-AGQDQQA- | ARPRAGD-TR | PLENGLDPGI | YKAI LVGKVG | 100

| Lead-cDNA-ID23492765 | QLPLQKKLKS | GRTVILLFSVG | TGGI RNNRRP | LINEDPREYA | SRSAVQWHRV | 140
| CeresClone:381106 | QEPMQKRLRS | GKTVVLFSLG | TGGI RNNRRP | LDREEPHQYA | DRCSVQWHRV | 149
| gi\|55297106 | QEPI QKRLRS | GRTVVLFSLG | TGGI RNNRRP | LDREEPHQYA | ERCSVQWHRV | 149
| gi\|34911652 | QEPI QKRLRS | GRTVVLFSLG | TGGI RNNRRP | LDREEPHQYA | ERCSVQWHRV | 143
| Consensus | QEPI QKRLRS | GRTVVLFSLG | TGGI RNNRRP | LDREEPHQYA | ERCSVQWHRV | 150

| Lead-cDNA-ID23492765 | SVYPERLADL | VLKNVEPGTV | LYLEGNLETK | IFTDPVTGLV | RRI REVAIR | 190
| CeresClone:381106 | CVYPDRLGTV | ALNNVKTGTI | LYLEGNLETK | VFCDPITGLV | RRI REI AVRS | 199
| gi\|55297106 | CI YPERLGSL | ALKHVKTGSV | LYLEGNLETK | VFSDPITGLV | RRI REI AVRS | 199
| gi\|34911652 | CI YPERLGSL | ALKHVKTGSV | LYLEGNLETK | VFSDPITGLV | RRI REI AVRS | 193
| Consensus | C-YPERLGSL | ALK-VKTG-V | LYLEGNLETK | VFSDPITGLV | RRI REI AVRS | 200

| Lead-cDNA-ID23492765 | NGRVVFLGKA | GDMQQPSSAE | LRGVGYY | 217
| CeresClone:381106 | SGRLLFLGN- | -DANAPKLGE | VKGVGYF | 224
| gi\|55297106 | NGRLLFLGN- | -DCNAPKLGE | AKGVGYF | 224
| gi\|34911652 | NGRLLFLGN- | -DCNAPKLGE | AKGVGYF | 218
| Consensus | NGRLLFLGN- | -DCNAPKLGE | -KGVGYF | 227

Figure 3

```
                                                                                              50
Lead-cDNA-ID23495742   MGRRKI KMEM  VQDMNTRQVT  FSKRRTGLFK  KASELATLCN  AELGIVVFSP    50
CeresClone:681294      MGRRKI EIAT  LKDPNTRQVT  FSKRRTGLFK  KANELSILCG  AEIAIVVFSI    50

Consensus              MGRRKI ----  --D-NTRQVT   FSKRRTGLFK  KA-EL--LC-  AE-IVVFS- 95
Lead-cDNA-ID23495742   GGKPFSYGKP   NLDSVAERFM  REYDDSDSGD  EEKSGNYRPL  ----KLKRLS   100
CeresClone:681294      GNKPYSFGHP   GVDVIAAKFL  QEAANSSDAK  QIDAQGNNPS  NELGDMNRLN Consensus              G-KP-S-G-P   -D---A--F-  -E-----S--  -------PS   NELG----RL-   100

145
Lead-cDNA-ID23495742   ERLDLLNQEV   EAEKERGEKS  QEKLESAGDE  RFKESIETLT  LDELNEYKDR   141
CeresClone:681294      QQLSDVQTQI   LEEEKKGAEH  DERLKQH---  -----QVTQ   LSQYKELQAS Consensus              ---L------   -E----G---  -E-L----GDE  RFKESI----  L-----E----  150

172
Lead-cDNA-ID23495742   LQTVHGRIEG   QVNHLQASSC  LMLLSRK---  -------     -----RRKKN   186
CeresClone:681294      YLELQHRVKD   YVNAIEVSEC  MILLAQEPVV  GITKQMTATK   RRKKN Consensus              ------R---   -VN----S-C  --LL---PVV  GITKQMTATK   RRKKN         195
```

Figure 6

| | | | | | |
|---|---|---|---|---|---|
| Lead-cDNA-ID23500996 | MSHIAVERNR | RRQMNEHLKS | LRSLTPCFYI | KRGDQASIIG | GVIEFIKELQ | 50
| CeresClone:545208 | MSHIAVERNR | RRQMNEHLKV | LRSLTPCFYI | KRGDQASIIG | GVIEFIKELH | 50
| Consensus | MSHIAVERNR | RRQMNEHLK- | LRSLTPCFYI | KRGDQASIIG | GVIEFIKEL- | 50

| | | | | | |
|---|---|---|---|---|---|
| Lead-cDNA-ID23500996 | QLVQVLESKK | RRKTLNRPSF | PYDHQTIEPS | SLGAATTRVP | FSRIEL--NVM | 98
| CeresClone:545208 | QVLQALESQK | RRKSLSPSPG | PI-SPRTLQPM | | FHQLDSPSMI | 89
| Consensus | Q--Q-LES-K | RRK-L----- | PY----T---P- | SLGAATTRVP | F------SP--- | 100

| | | | | | |
|---|---|---|---|---|---|
| Lead-cDNA-ID23500996 | TTSTFKEVGA | CCNSPHANVE | AKISGSNVVL | RVVSRRIVGQ | LVKIISVLEK | 148
| CeresClone:545208 | GTNSFKELGA | SCNSPVADVE | VKISGSYVIL | KVICHRIPGQ | VAKIITVLES | 139
| Consensus | -T---FKE-GA | -CNSP-A-VE | -KISGS-V-L | -V----RI-GQ | -KII--VLE- | 150

| | | | | | |
|---|---|---|---|---|---|
| Lead-cDNA-ID23500996 | LSFQVLHLNI | SSMEETVLYF | FVVKIGLECH | LSEELTLEV | QKSFVSDEVI | 198
| CeresClone:545208 | LSFEVLHLNI | SSMEETVLYQ | FVVKIELGCQ | LSEELAMEV | QQSFCLDAII | 189
| Consensus | LSF-VLHLNI | SSMEETVLY- | FVVKI-L--C- | LSLEEL--EV | Q-SF--D---I | 200

| | |
|---|---|
| Lead-cDNA-ID23500996 | VSTN | 202
| CeresClone:545208 | AL-- | 191
| Consensus | ---TN | 204

Figure 7

| | | | | | | | |
|---|---|---|---|---|---|---|---|
| gi\|861091 | | ---MDMECSIG | TKEH--LAKGK | RTKRGIRMLS | PCTVANTTVT | SSC---SSALG | 45 |
| Lead-cDNA-ID23515088 | | --MGQDEVG | SDQT-QI-KGK | RTKRQRSSST | FVVTAATTVT | STS--SSAGG | 45 |
| gi\|2346972 | | MEVQMQEDHD | HHMNMVIKRR | RTKRPRPSSP | LALITATSSC | SIVEGTHAGE | 50 |
| Consensus | | ---MQ----G | --------I KGK | RTKR-R-SS- | ---TAATTVT | ST---SSAGG | 50 |

| | | | | | | | |
|---|---|---|---|---|---|---|---|
| gi\|861091 | DCGRSFSSTT | FDSITE---- | ----QEEEADM | ANCLILLAQG | RTGGQEETRC | 87 |
| Lead-cDNA-ID23515088 | SGGERAVSDE | YNSAVSSPVT | TDCTQEEEDM | ALCLIMLARG | TVLPSPDLKN | 95 |
| gi\|2346972 | LDGHVANSSS | SPSNSGIDLL | IR-NREEEDM | ANCLILLAQG | ---------- | 89 |
| Consensus | -GG--A--S-- | --S------- | ----EEEDM | ANCLILLAQG | ---------- | 100 |

| | | | | | | | |
|---|---|---|---|---|---|---|---|
| gi\|861091 | HNFRQQDGGY | NNIVTEKATR | NGFESYECKT | CNRFFHSFQA | LGGHRASHKK | 137 |
| Lead-cDNA-ID23515088 | SRKIHQK--- | ---ISSEN | SSFYVYECKT | CNRTFSSFQA | LGGHRASHKK | 137 |
| gi\|2346972 | --HNNQK--- | ----PSPSH | SPLDVYQCKT | CNRCFPSFQA | LGGHRASHKK | 129 |
| Consensus | --H----QK-- | --------S | S-F-VYECKT | CNR-F-SFQA | LGGHRASHKK | 150 |

| | | | | | | | |
|---|---|---|---|---|---|---|---|
| gi\|861091 | PKMKEII SAG | ETEEQNNHI H | NKNVSTISPL | VPPHVSLELR | CGGNLNFHGH | 187 |
| Lead-cDNA-ID23515088 | PR---- TST | EEKTRLPLTQ | PKS-SASEEG | QNSHFKV--- | SGSALASQAS | 178 |
| gi\|2346972 | PKLP---- TNL | EEKNSKPIEH | VENCSKSNED | HVITFLSLQT- | SNNNINNNNS | 175 |
| Consensus | PK------T-- | EEK----P--H | -KN-S-S-E- | ---H-SL--- | SG-NLN---S | 200 |

| | | | | | | | |
|---|---|---|---|---|---|---|---|
| gi\|861091 | ----GNNNKPN | RSNKVHECSI | CGAEFTSGQA | LGGHIRRHR- | ----AC | 225 |
| Lead-cDNA-ID23515088 | ------NITN | KANKVHECSI | CGSEFTSGQA | LGGHMRRHRT | AVTITSPVAA | 222 |
| gi\|2346972 | NNNNNNNIK | NKNRVHECSI | CGAEFTSGQA | LGGHMRRHRP | LPNSIAIAST | 225 |
| Consensus | ----NNNIN | --NKVHECSI | CGAEFTSGQA | LGGHMRRHR- | ----I----A | 250 |

| | | | | | | | |
|---|---|---|---|---|---|---|---|
| gi\|861091 | TNKNNNN--- | ----NVGDV | HGKTRNILEL | DLNLPAPEED | LR-DSTFQF- | 265 |
| Lead-cDNA-ID23515088 | AEVSRNSTE | EEIEINIGRS | MEQQRKYLPL | DLNLPAPEDD | LR-ESKFQG- | 270 |
| gi\|2346972 | SHELESS--- | ----HE | LKNTRNFLSL | DLNLPAPEDD | HRPETKFSFA | 264 |
| Consensus | T-E----N-- | ------N-G-- | ---TRN-L-L | DLNLPAPEDD | LR-ESKFQF- | 300 |

```
gi|861091         ----------PAMVGCHY    273
Lead-cDNA-ID23515088  ----VFSA TPALIDCHY  284
gi|2346972       SKEQVIVFSA SPLVDCHY    282

Consensus        ------IVFSA -PALVDCHY    319
```

| | | | | | | |
|---|---|---|---|---|---|---|
| Lead-cDNA-ID23522373 | M<u>C</u>SSEMEKS<u>G</u> | KEKEPKT<u>T</u>PP | ST<u>SSSAPA</u>T<u>V</u> | VSQEPSSAVS | AGVA<u>M</u>T<u>Q</u>DWS | 50 |
| CeresClone:1188156 | MASNEMEKSS | KEKEPKTPPP | --SSTAPPS- | -SQEPSSAVS | AGMA-TPDWS | 45 |
| gi\|42570366 | MASNEMEKSS | KEKEPKTPPP | --SSTAPPS- | -SQEPSSAVS | AGMA-TPDWS | 45 |
| gi\|3608135 | MASNEMEKSS | KEKEPKTPPP | --SSTAPPS- | -SQEPSSAVS | AGMA-TPDWS | 45 |
| Consensus | MASNEMEKSS | KEKEPKTPPP | --SSTAPPS- | -SQEPSSAVS | AGMA-TPDWS | 50 |
| Lead-cDNA-ID23522373 | GFQAYSPM<u>-P</u> | PHGYVASSPQ | PHPYMWGVQH | MMPPYGTPPH | PYV<u>I</u>MYPPGG | 99 |
| CeresClone:1188156 | GFQAYSPMPP | PHGYVASSPQ | PHPYMWGVQH | MMPPYGTPPH | PYVAMYPPGG | 95 |
| gi\|42570366 | GFQAYSPMPP | PHGYVASSPQ | PHPYMWGVQH | MMPPYGTPPH | PYVAMYPPGG | 95 |
| gi\|3608135 | GFQAYSPMPP | PHGYVASSPQ | PHPYMWGVQH | MMPPYGTPPH | PYVAMYPPGG | 95 |
| Consensus | GFQAYSPMPP | PHGYVASSPQ | PHPYMWGVQH | MMPPYGTPPH | PYVAMYPPGG | 100 |
| Lead-cDNA-ID23522373 | MYAHPSLPPG | SYPYSPYAMP | SPNGMA<u>E</u>A<u>SG</u> | NT<u>G</u>SV<u>I</u> <u>E</u>GD<u>G</u> | K<u>P</u>S<u>D</u>GKEKLP | 149 |
| CeresClone:1188156 | MYAHPSMPPG | SYPYSPYAMP | SPNGMTEVSG | NTTGGTDGDA | KQSEVKEKLP | 145 |
| gi\|42570366 | MYAHPSMPPG | SYPYSPYAMP | SPNGMTEVSG | NTTGGTDGDA | KQSEVKEKLP | 145 |
| gi\|3608135 | MYAHPSMPPG | SYPYSPYAMP | SPNGMTEVS<u>I</u> | ---VSGTDGDA | KQSEVKEKLP | 142 |
| Consensus | MYAHPSMPPG | SYPYSPYAMP | SPNGMTEVSG | NTT-GTDGDA | KQSEVKEKLP | 150 |
| Lead-cDNA-ID23522373 | KRSKGSLGS | LNMI<u>L</u>GKNNE | A<u>G</u>KNSGASAN | CA<u>C</u>S<u>KSA</u>E<u>SG</u> | <u>S</u>DGSSDGSD<u>A</u> | 199 |
| CeresClone:1188156 | IKRSRGSLGS | LNMITGKNNE | PGKNSGASAN | GAYSKSGESA | SDGSSEGSDG | 195 |
| gi\|42570366 | IKRSRGSLGS | LNMITGKNNE | PGKNSGASAN | GAYSKSGESA | SDGSSEGSDG | 195 |
| gi\|3608135 | IKRSRGSLGS | LNMITGKNNE | PGKNSGASAN | GAYSKSGESA | SDGSSEGSDG | 192 |
| Consensus | IKRSRGSLGS | LNMITGKNNE | PGKNSGASAN | GAYSKSGESA | KQSEVKEKLP | 150 |
| | | | | | | |
| | IKRSRGSLGS | LNMITGKNNE | PGKNSGASAN | GAYSKSGESA | SDGSSEGSDG | 200 |
| Lead-cDNA-ID23522373 | NSQNDSGS<u>RH</u> | NGKD<u>G</u>E<u>TASE</u> | SGGSAHGP<u>PR</u> | NGSN----<u>LP</u> | V<u>NQTVA</u>T MPV | 245 |
| CeresClone:1188156 | NSQNDSGSGL | DGKDAEAASE | NGGSANG-PQ | NGSAGTPILP | VSQTVPIMPM | 244 |
| gi\|42570366 | NSQNDSGSGL | DGKDAEAASE | NGGSANG-PQ | NGSAGTPILP | VSQTVPIMPM | 244 |
| gi\|3608135 | NSQN<u>SS</u>L<u>FF</u> | HS--AEAASE | NGGSANG-PQ | NGSAGTPILP | VSQTVPIMPM | 239 |
| Consensus | NSQNDSGSGL | DGKDAEAASE | NGGSANG-PQ | NGSAGTPILP | VSQTVPIMPM | 250 |

Figure 8 (Continued)

```
Lead-cDNA-ID235522373   SAT GVPGPPT   NLNI GMDYWS   G---------   HGN VSGA VPG   VVV----DGS    282
CeresClone:1188156      TAAGVPGPPT    NLNI GMDYWG   APTSAGI PGM   HGKVSTPVPG   VVAPGSRDGG    294
gi|42570366             TAAGVPGPPT    NLNI GMDYWG   APTSAGI PGM   HGKVSTPVPG   VVAPGSRDGG    294
gi|3608135              TAAGVPGPPT    NLNI GMDYWG   APTSAGI PGM   HGKVSTPVPG   VVAPGSRDGG    289

Consensus               TAAGVPGPPT    NLNI GMDYWG   APTSAGI PGM   HGKVSTPVPG   VVAPGSRDGG    300

Lead-cDNA-ID235522373   QSQPWLQDER    EI KRQRRKQS   NRESARRSRL    RKQAECDELA   QRAEVLNGEN    332
CeresClone:1188156      HSQPWLQDDR    ELKRQRRKQS   NRESARRSRL    RKQAECDELA   QRAEVLNEEN    344
gi|42570366             HSQPWLQDDR    ELKRQRRKQS   NRESARRSRL    RKQAECDELA   QRAEVLNEEN    344
gi|3608135              HSQPWLQDDR    ELKRQRRKQS   NRESARRSRL    RKQAECDELA   QRAEVLNEEN    339

Consensus               HSQPWLQDDR    ELKRQRRKQS   NRESARRSRL    RKQAECDELA   QRAEVLNEEN    350

Lead-cDNA-ID235522373   SSLRAEI NKL   KSQYEELLAE   NSSLKNKFSS    APSLEGGDLD   KNEQEPQRS-    381
CeresClone:1188156      TNLRAEI NKL   KSQCEELTTE   NTSLKDQLSL    LPPLEGI SMD   NDHQEPDTNQ    394
gi|42570366             TNLRAEI NKL   KSQCEELTTE   NTSLKDQLSL    FPPLEGI SMD   NDHQEPDTNQ    394
gi|3608135              TNLRAEI NKL   KSQCEELTTE   NTSLKVKK--    ----------   ----------    368

Consensus               TNLRAEI NKL   KSQCEELTTE   NTSLKD-LSL    -PPLEGI SMD   NDHQEPDTNQ    400

Lead-cDNA-ID235522373   ---------T   RQDVA         387
CeresClone:1188156      TGAAERKVDS   YKDST         409
gi|42570366             TGAAERKVDS   YKDST         409
gi|3608135              ----------   -----         368

Consensus               TGAAERKVDS   YKDST         415
```

Figure 9

```
                          HCDRAI PAA    NI DLHYAHCS    RKLEKCKVCG   42
CeresClone:852336   MEAVSDQD- -------   ---TSI C      
CeresClone:969293   MATETGEI  -------   ---TIVC       NHCDRDI PAP    NI DLHRVHCA    RNLEKCKI CG   42
Lead-cDNA:ID23529806 METATGEI -------   ---TIVC       NHCDRDI PSL    NI DLHRVHCA    RNLEKCKI CG   42
gi|21593788        METATGEI  -------   ---TIVC       NHCDRDI PSL    NI DLHRVHCA    RNLEKCKI CG   42
gi|50939745        MAAAAADS- ADPVIT    TATC          AHCHREI PSP    NI ALHSAHCA    RNLQKCEHCG   48
CeresClone:234649  MAAAAADSDT AAAVGAMST C             AHCQREI PFL    NI DLHSVHCA    RNLQKCQHCG   50
CeresClone:460881  MAAAADSDP  AAAVADMST C             AHCQREI PSS    NI DLHSVHCA    RNLQKCQHCG   50

Consensus           MAAA----- -------   ---TSVC       -HCDR-I PS-    NI DLH-VHCA    RNLEKCKI CG   50

CeresClone:852336   DMVPRKNAED HYLSTHAPVS            CSLCSETMER    DI LDI HKGEN    CPQRI VTCQF   92
CeresClone:969293   DMVPKKHAEE HFLNTHAPVP            CSMCKETI DR    EVFNSHTEEI    CPKRMVT CEF   92
Lead-cDNA:ID23529806 DMVPKKHAEE HYLNTHAPI A           CSMCKETI ER    EI FDJHKGEI    CPKRI VT CEF   92
gi|21593788        DMVPKKHAEE HYLNTHAPI A             CSMCKETI ER    EI FDSHKGEI    CPKRI VT CEF   92
gi|50939745        YMVPKKLMDE HYDENHAPMI            CSLCQKTVQR    ELWDLHKGLQ    CPQRMLACQY   98
CeresClone:234649  EMI PRKLMDE HYDENHAPI N            CSLCKETI ER    ESWDLHKGEK    CPQRI VACEY   100
CeresClone:460881  EMI PRKLMDE HYDANHAPI S            CSLCKETI ER    VRWDLHKGEK    CPQRI VACEY   100

Consensus           DMVPKKHAEE HYL-THAPI -            CSMCKETI ER    EI -DLHKGE-    CPQRI VT CEF   100

CeresClone:852336   CEFPLPAI DL AEHQEVCGNR            TELCHI LCNKY   VRLRERFSHE    ARCNGI QDSS   142
CeresClone:969293   CEFPLPAVDL AEHQEVCGNR             TELCYQCNSY    VRLRETYNHE    TKCPGSVXNT   142
Lead-cDNA:ID23529806 CEFPLPAVDL AEHQEVCGNR           TELCYQCNSY    VRLRERYNHE    TKCPG----T   138
gi|21593788        CEFPLPAVDL AEHQEVCGNR             TELCYQCNSY    VRLRERYNHE    TKCPG----T   138
gi|50939745        CDFELPAADI YEHQDVCGNR             TEYCQPCRKY    VRLREQI GHD    QFHSQPI VA   148
CeresClone:234649  CEFELPAVDL HEHQDVCGNR              TELCQTCRKY    RLREWT GHE     QCHTNSNGS   150
CeresClone:460881  CEFELPAVDL HEHQDVCGNR              TELCQTCRKY    RLCEWI GHE     QCHTSSNGX   150

Consensus           CEFPLPAVDL AEHQEVCGNR             TELCY-CNKY    VRLRERYNHE    ---CHG----   150
```

CeresClone:852336       VGTS--RNVR  EAERE----Q  GARRRPLPXQ  NDXSTKRLLF  TI AI TGI AVI
CeresClone:969293       VESS--RRIP  RAAEG----D  CNGRRR--RRD  NGVXNKRLXF  XI AI TGI AVL
Lead-cDNA-iD235529806   VESS--RRIP  RAAEG----D  GNGRRR-RDG  NGVSNKRLFF  TI AI TGI AVI
gi|21593788             VESS--RRIP  RAAXG----D  GNGRRX-XEG  NGVSNKRLFF  TI AI TGI AVI
gi|50939745             SESSSDRSTL  EEEES-YPAE  EQPVRP-KHT  HGLQRKQFLV  TI VI AGI SI L
CeresClone:234649       ADTS--RAIP  EREL-RPPPPP  VRQARPARPA  HASPHKRLLF  TI AVTGI AVM
CeresClone:460881       ADTSSARAIP  EREL-R-PPPP  VRPARPARPA  HXSPHKRLLF  TI AVTGI AVM
                                                                                            200

Consensus               VETS--R-IP  EAE-------  G--RRP--R--  HGV-NKRLLF  TI AI TGI AVI CeresClone:852336       LGSEFXQRKA  DPSDVH      202
CeresClone:969293       IGSLXFQRKP  EGS---      197
Lead-cDNA-iD235529806   IGSLFFQRKP  E-----      192
gi|21593788             IGSLFFXRKP  E-----      192
gi|50939745             VGSVLLKKGW  LS----      208
CeresClone:234649       IGSI LFQRDE  GF----      210
CeresClone:460881       VGSI LFQRDE  SF----      211

Consensus               IGSL-FQRK-  E-----      216
```

Figure 10

```
Lead-cDNA-ID23530574   MAGGSKSPAS  SLEDGKAYVN  AVKVALEEAE  PAKYQEFLRL  FHEVIARRMG   50
gi|7486367             MAGGSLSPAS  SLEDVKAYVN  AVEVALQEME  PARFGMFVRL  FRGFTAPRIG   50
Consensus              MAGGS-SPAS  SLED-KAYVN  AV-VAL-E-E  PA----F-RL  F----A-R-G   50

Lead-cDNA-ID23530574   MATFSARMQD  LLKDHPSLCL  GLNVMLAPEY  QRAIPPEASE  EFHKVVGRSV  100
gi|7486367             MPTFSARMQD  LLKDHPSLCL  GLNVLLPPEY  QLTIPPEASE  EFHKVVGRSV  100
Consensus              M-TFSARMQD  LLKDHPSLCL  GLNV-L-PEY  Q---IPPEASE EFHKVVGRSV  100

Lead-cDNA-ID23530574   ----------  -PRPEPTIDD  ATSYLIAVKE  AFHDEPAKYE  EMLKLLNDFK  139
gi|7486367             PVPPKVVGRS  LPRPEPTIDD  ATSYLIAVKE  AFHDEPAKYG  EMLKLLKDFK  150
Consensus              PVPPKVVGRS  LPRPEPTIDD  ATSYLIAVKE  AFHDEPAKY-  EMLKLL-DFK  150

Lead-cDNA-ID23530574   ARRVNAASVI  ARVEELMKDH  SNLLFGFCVF  LSATTSFTTK  LKAKFQGDGS  189
gi|7486367             ARRVDAACVI  ARVEELMKDH  LNLLFGFCVF  LSATTSFTTK  LKARFQGDGS  200
Consensus              ARRV-AA-VI  ARVEELMKDH  -NLLFGFCVF  LSATTSFTTK  LKA-FQGDGS  200

Lead-cDNA-ID23530574   QVVDSVLQIM  RMYGEGNKSK  HDAYQEIVAL  VQGHDDLVME  LSQIFTDPST  239
gi|7486367             QVVDSVLQIM  RMYGEGNKSK  HDAYQEVVAL  VQGHDDLVME  LSQILTDPPT  250
Consensus              QVVDSVLQIM  RMYGEGNKSK  HDAYQE-VAL  VQGHDDLVME  LSQI-TDP-T  250

Lead-cDNA-ID23530574   RV          241
gi|7486367             GV          252
Consensus              -V          252
```

Figure 11

```
                                                                                                           41
Lead-cDNA:ID235544687   MENSY-------- ----DSSKWS DSTTPYMVSW SLQSESSDSD MNRFNLGFSS    50
CeresClone:474183       MESYYYSGWP    LAQFNSAPNS DQLSPFSVPT TTQQTLPLVA TSTSDRAAAA Consensus               ME---YYSGWP   LAQF-S----S  D----P--V--  --Q--------  ----------

90
Lead-cDNA:ID235544687   SSFGGNFPA-   DDCVGGIEKA ESLSRSHRLA EKRRRQRINS HLTALRKLVP    100
CeresClone:474183       SLQFGEFPSW   PAPIAAEDRA ASASKSHSQA EKRRRDSINA QLATLRKLIP Consensus               S----G-FP-W  ---------- -S-S-SH---A EKRRRD-IN- -L---LRKL-P 140
Lead-cDNA:ID235544687   NSDKLDKAAL   LATVIEQVKE LKQKAAESPI FQDLPTEADE VTVQPETISD    150
CeresClone:474183       MSDKMDKATL   LGSVVDHVKD LKRKAMDVSK AITVPTETDE VTIDYHQAQD Consensus               -SDK-DKA-L   L--V---VK- LK--KA---- ----PTE-DE VT-------D 184
Lead-cDNA:ID235544687   --FESNTN--   TIIFKASF   CCEDQPEAIS EIIRVLTKLQ LETIQAEIIS    200
CeresClone:474183       ESYTKKVNIL   KENIIKASV  CCDDRPELFP ELIQVLKGLR LTAVKADIAS Consensus               ES-----NI L  KE-II-KAS- CC-D-PE--- E-I-VL--L- L---A-I--S 234
Lead-cDNA:ID235544687   VGGRMRINFI   LKDSNCNETT NIAASAKALK QSLCSALNRI TSSSTTTSSV   246
CeresClone:474183       VGGRIKSILV   LCSKDSEENN SVCLS---TLK QSLKSAVNKI ASLSVATN--

Consensus               VGGR-------  L------E-- ----SAK-LK QSL-SA-N-I -S-S---T-SV 254
Lead-cDNA:ID235544687   CRIRSKRQRW   FLSSHYSHNE  AIF xx FVF                         279
CeresClone:474183       CPTRSKRQRF   FLPSHYVQXF  NSX                                283

Consensus               C--RSKRQR-   FL-SHY---N- IAIF---IFVF NS--
```

Figure 12

| | | | | |
|---|---|---|---|---|
| CeresClone:1534270 | ----MMANGRF | Q----KQA | LLPPRSPFPV | AA------P | HAELGPIARP | 34 |
| Lead-cDNA-ID23557940 | MASSKGSQSV | RNLMYPGKHA | LLPPKIPFPS | VSASYSEYIP | TGLIGSRHGQ | 50 |
| CeresClone:475730 | MANSKGSSSF | RNFMYPGKHP | LLPPKSPFPS | VSQAYADYVP | NPAVGLKAGN | 50 |

Consensus    MA-SKGS-SF  RN-MYPGKHA  LLPPKSPFPS  VS---Y--Y-P  -----G--AG-   50

| CeresClone:1534270 | RETPHRHGHQ | RTSSESFLAD | EQPSWLDDLL | DE-PETPARA | HGRPGHRRSS | 83 |
| Lead-cDNA-ID23557940 | KLSNEKTHHQ | RTSSESHLVE | ELPFWLDDLL | NEQPESPAR- | --KCGHRRSS | 97 |
| CeresClone:475730 | RPRDGNTHHQ | RTSSESLVIE | EQPSWLDDLL | NE-PETPVR- | --RGGHRRSS | 96 |

Consensus    R-----THHQ  RTSSES-L-E  EQPSWLDDLL  NE-PETPAR-  ---R-GHRRSS   100

| CeresClone:1534270 | SDSFALFEGG | SAAG------ | GMYEFDNVLD | ------- | VASLAGAPEF | 124 |
| Lead-cDNA-ID23557940 | SDSYAYLDVA | NATNISLTLQ | NDFSYRNTVL | STQRGVQELD | RNKNAQDAAF | 147 |
| CeresClone:475730 | SDSFAYIDTV | NASNLNYASQ | DEYKYKNMMS | PPWSPQDFD | CSKDARHVPV | 146 |

Consensus    SDSFAY-D--  NA-N------Q  --Y--Y-N--  ----G--Q--D  --K-A----F   150

| CeresClone:1534270 | FPEPASFGRP | WESRQMTRQG | GCMPI--MPGR | EKNGGRHGPS | SSFGEHELGH | 172 |
| Lead-cDNA-ID23557940 | YSGASFLKQK | SRQRDSLVAT | GACPSWLPFA | RENGGCKNLG | ALYMSQDATV | 197 |
| CeresClone:475730 | YAEMNSITKQK | NRSWDSFSNA | MTNPVGVPSG | KDSAAFQSSG | LQCTPHEADA | 196 |

Consensus    Y-E--S-KQK  -RSRDS-----  G---P----P--  ---NGG-----G  -------HEA---   200

| CeresClone:1534270 | V-DNGVNRKA | VIERKEGLRH | SQSI---ETD- | TKRAKQQYAQ | 217 |
| Lead-cDNA-ID23557940 | I--SSERKN | MLSSEENNSN | PSPVTYEADN | TKRAKQQFAQ | 244 |
| CeresClone:475730 | LPPAASEKHD | SVELLGLQDAK | SFPEKKDISH | AKSSASETD- | TKRAKQQFAQ | 245 |

Consensus    --P--SERK-  --E----D-K  ----KE--SH  --S----ETD-  TKRAKQQFAQ   250

| CeresClone:1534270 | RSRVRKLQYI | AELERRVQSL | QIEGLEVTAE | MDFLGQQNIM | LDLENKALKQ | 267 |
| Lead-cDNA-ID23557940 | RSRVRKLQYI | SELERNVQTL | QAEGSKVSAE | LDFLNQRNLI | LSMENKALKK | 294 |
| CeresClone:475730 | RSRVRKLQYI | AELERNVQAL | QAEGSEVSAE | LEFLNQQNLI | LSMENKALKQ | 295 |

Consensus    RSRVRKLQYI  AELERNVQ-L  QAEGSEVSAE  LDFLNQQNLI  LSMENKALKQ   300

Figure 12 (Continued)

```
CeresClone:1534270      RLESLSQEHL  KRY------- ---------- -QQEMFEREI GRLRLFQQQ   300
Lead-cDNA-ID235557940   RLESIAQEKL  KQYSTVLKI  ---------- VEQEVLEKEI GRLRALYQQQ  344
CeresClone:475730       RLENIAQEQL  KYL------- VYLMSSVYYP -EQEVLEREI GRLRALYQQQ  328

Consensus               RLESIAQE-L  IK-Y------ ---------- -EQEVLEREI GRLRALYQQQ  350

CeresClone:1534270      QQQHVPQQ    APL--THSRSN SRDLDSQFAN LSLKHSDPSS GRDAISGLRI 348
Lead-cDNA-ID235557940   QQ------TQ  KPSASRGRAT SKDLDSQFSS LSLNT KDSNC RRDSVSVMGQ 388
CeresClone:475730       QQPPQTQPQQ  QPSGSHRRSN SRELESQFAN LSLKFKDTNS GQD--PALRI 376

Consensus               QQ------QQ  -PS-SH-RSN SRDLDSQFAN LSLKHKD-NS GRD--S-LRI 400

CeresClone:1534270      ---         348
Lead-cDNA-ID235557940   FHF         391
CeresClone:475730       ---         376

Consensus               ---         403
```

Figure 13

| | | | | | | |
|---|---|---|---|---|---|---|
| Lead-cDNA-ID23653450 | MAGFSLYCFK | NPRILFTLPS | ESPLFVLGSD | KCSPAIRRPS | RKTRGFMTY | 50 |
| gi\|50938747 | ---------- | ---MAP | ---------- | ---------- | AARRGAVAFS | 37 |
| CeresClone:918824 | ---MALLQLH | PPPLAALGRS | VLPCRPF--- | ---PSATATA | RRSLASVAFS | 41 |
| Consensus | -------L-- | PPPLAAL-PS | ---PL----- | -------P-A | R--RG-VAFS | 50 |
| | | | | | | |
| Lead-cDNA-ID23653450 | AHSNPKIINP | KKKSRYGQTL | SPYDSDEDDD | DDDD------ | ---------- | 86 |
| gi\|50938747 | LQTNVRLLKP | NRRSRRRSR-Y | PYYDHDEDED | DDEAEFEFEE | GEEEEEDGYE | 86 |
| CeresClone:918824 | LQTNVRLLKP | NRRSRRRSR-Y | PYYDLDDDEE | EEDEEYDEDD | ---------E | 81 |
| Consensus | LQTNVRLLKP | NRRSRRRSR-Y | PYYD-DEDED | DDD-E----- | ---------E | 100 |
| | | | | | | |
| Lead-cDNA-ID23653450 | DDDMLNDDF | AEMTEYEKKK | PKSHKQTIAK | KSVKKGIVKP | EESETDEDDL | 136 |
| gi\|50938747 | TDDDLSGLEY | PGVLYSNNPR | APLKKPGREK | PALKQNWEGR | QPKTRDRCDT | 136 |
| CeresClone:918824 | SEDDLSGLEY | LGVLYTNNPR | APNKRAGRKT | QLVKENWEGR | RPKTRDKHAS | 131 |
| Consensus | -DDDLSGLEY | -GVLY-NNPR | AP-KK-GR-K | --VK-NWEGR | -PKTRD---D- | 150 |
| | | | | | | |
| Lead-cDNA-ID23653450 | DLGISPNATS | EKKKES---- | WRLDGRGKMS | SRKYVEKLYP | RLAEELDLDP | 182 |
| gi\|50938747 | SKKVDALHAK | SKASRS--TG | VDIDNEVELK | NESISRSLFQ | KLQEEYDFDD | 185 |
| CeresClone:918824 | PGRSNSLQPR | SKINRTLLNL | TSMNSEVELK | NESISRILFE | KLQEEYDFDD | 181 |
| Consensus | --------L-- | SK---RS---L | ---D-EVELK | NESISR-LF- | KLQEEYDFDD | 200 |
| | | | | | | |
| Lead-cDNA-ID23653450 | KCVPLLDYLS | TFGLKESHFV | QMYERHMPSL | QINVFSAQER | LDYLLSVGVK | 232 |
| gi\|50938747 | KWLPLIDYLC | TFGLKESHFT | NMYERHMACF | QISQASAEER | LEFLLSVGVK | 235 |
| CeresClone:918824 | KWLPLIDYLC | SFGLRESHFT | YIYERHMACL | QINRASAEER | LEFLLSVGVK | 231 |
| Consensus | KWLPLIDYLC | TFGLKESHFT | -MYERHMACL | QIN-ASAEER | LEFLLSVGVK | 250 |
| | | | | | | |
| Lead-cDNA-ID23653450 | HRDIKRMLLR | QPQILQYTVE | NNLKAHISFL | MGLGIPNSKI | GQIVAALPSL | 282 |
| gi\|50938747 | SKDMKRMLVR | QPQILEYTL- | SNLKSHVAFL | VGIGVPSARI | GQIISAAPSF | 284 |
| CeresClone:918824 | SKDLKRMLVR | QPQILEYTL- | SNLKSHVAFL | AGIGVPDARM | GQIISSAAPSF | 280 |
| Consensus | SKD-KRMLVR | QPQILEYTL- | SNLKSHVAFL | -GIGVP-ARI | GQIISAAPSF | 300 |

Figure 13 (Continued)

```
Lead-cDNA-ID23653450   FSYSVENSLR  PTIRYLIEEV  GIKETDVGKV  VQLSPQILVQ  RLDLIMNTRY   332
gi|50938747            FSYSVEQSLK  PTIRYLIEEV  GIEESDVGKV  VQLSPQILVQ  RIDSAWKSRF   334
CeresClone:918824      SYSIEQSLK   PTISYLIEEV  GIEERDVGKV  VQLSPQILVQ  RIDNAWKSRF   330

Consensus              FSYSVEQSLK  PTIRYLIEEV  GIEE-DVGKV  VQLSPQILVQ  RID-AWKSRF   350

Lead-cDNA-ID23653450   MFLSKELGAP  RDSVVKMVKK  HPQLLHYSID  DGFLPRINFL  RSIGMCNSDI   382
gi|50938747            LFLSKELGAP  KDNIVKMVTK  HPQLLHYSIE  DGILPRINFL  RSIGMRDTDV   384
CeresClone:918824      LFLSKELGAP  KDSIVKMVTK  HPQLLHYSIE  EGILPRINFL  RSIGMRNSDI   380

Consensus              LFLSKELGAP  KDSIVKMVTK  HPQLLHYSIE  DGILPRINFL  RSIGMRNSDI   400

Lead-cDNA-ID23653450   LKVLTSLTQV  LSLSLEDNLK  PKYMYLVNEL  NNEVLLTKY   PMYLSLSLDQ   432
gi|50938747            LKVLTSLTQV  LSLSLEENLK  PKYLYLVNDL  KNDVQSLTKY  PMYLSLSLDQ   434
CeresClone:918824      LKILTSLTQV  LSLSVEKNLK  PKYLYLVNDL  KNEAQSLTKY  PMYLSLSLEQ   430

Consensus              LKVLTSLTQV  LSLSLE-NLK  PKYLYLVNDL  KNEVQSLTKY  PMYLSLSLDQ   450

Lead-cDNA-ID23653450   RIRPRHRFLV  ELKKVRKGPF  PLSSLVPNDE  SFCQQWAGTS  VDIYLAFRQR   482
gi|50938747            RIRPRHRFLV  SLKKAPKGPF  PLSSFVPTDE  RFCKRWAGTS  LEKYHTFRQS   484
CeresClone:918824      RIRPRHRFLV  SLKKAPKGPF  PLSSFVLTDE  RFCQRLAGTS  LEKYHTFRQS   480

Consensus              RIRPRHRFLV  SLKKAPKGPF  PLSSFVPTDE  RFCQRWAGTS  LEKYHTFRQS   500

Lead-cDNA-ID23653450   LLLKEFANKY  DKRG----              496
gi|50938747            MLLKGFSEKT  GRKTLTSRR             503
CeresClone:918824      LLLTGFEDKT  GRKPLASRR             499

Consensus              LLLKGF--KT  GRK-L-SRR             519
```

Figure 14

| | | | | | | |
|---|---|---|---|---|---|---|
| Lead-cDNA-ID24374230 | MAALSEHTIL | QFVSPSSTAS | ATTSVLTARI | HPLVIFNVCD | CFVRRPDSAE | 50 |
| CeresClone:1507510 | MAAANEHTVL | QFATPSST-- | --TSILTARI | HPLVIFNVCD | CFVRRPDSAE | 46 |
| gi|50931081 | -MAAAEGPVL | LFPSTSS--- | --TS---ARV | EAVVVFNICD | SYVRRPDQAE | 41 |
| CeresClone:500887 | ---MATPIPAL | LFPSPSSASS | PPSS---AQV | EAVVLFNVCD | SYVRRPDQAD | 44 |
| Consensus | MAAAAEH-VL | -FPSPSST-S | --TS-LTAR- | ---VIFNVCD | --VRRPD-AE | 50 |
| Lead-cDNA-ID24374230 | RVIGTLLGSI | LPDGTVDIRN | SYAVPHNESS | DQVAVDIDYH | HNMLASHLKV | 100 |
| CeresClone:1507510 | RVIGTLLGSI | LPDGTVDIRN | SYAVPHNESS | DQVAVDIDYH | HNMLASHLKV | 96 |
| gi|50931081 | RVIGTLLGSV | LPDGTVHVRN | SYVPHNESP | DQVALDIEYH | HNMYASHHKV | 91 |
| CeresClone:500887 | RVIGTLLGSL | LPDGTVHVRN | SYVVPHSESA | DQVAIDIDYH | HNMYASHQKV | 94 |
| Consensus | RVIGTLLGSI | LPDGTV---RN | SY-VPHNESS | DQVAVDIDYH | HNM-ASHLKV | 100 |
| Lead-cDNA-ID24374230 | NSKEIVGWY | STGAGVNGGS | SLIHDFYARE | VPNPIHLTVD | TGFTNGEGTI | 150 |
| CeresClone:1507510 | NPKEIVGWY | STGLGVNGGS | ALIHDFYARE | AINPIHLTVD | TGFTNGEGAI | 146 |
| gi|50931081 | NPKEVIGWF | STGFGVSGGS | TLIHDFYSRE | VQSPIHLTVD | TGFTRGDASI | 141 |
| CeresClone:500887 | NPKEVIGWF | STGFGVSGGS | TLIHEFYSRE | VQSPIHLTVD | TGFTRGEASI | 144 |
| Consensus | NPKEVIGW- | STGFGV-GGS | TLIHDFY-RE | VQ-PIHLTVD | TGFT-GE-SI | 150 |
| Lead-cDNA-ID24374230 | KAFVSSNLSL | GDRQLVAHFQ | EIPVDLRMVD | AERVGFDVLK | ATSVDKLPND | 200 |
| CeresClone:1507510 | KAFVSSNLSL | GDRQLAAQFQ | EVPVDLRMVE | AERVGYDVLK | ATAVDKLPND | 196 |
| gi|50931081 | KAYISSNLSL | GDRHLAAQFQ | EIPLDLRMLE | AGKVGFDILK | STIVEKLPND | 191 |
| CeresClone:500887 | KAYVSSNLSL | GDRQLAAQFQ | EIPLDLRMIG | AEKAGFEILK | STMVEKLPND | 194 |
| Consensus | KA-VSSNLSL | GDRQLAAQFQ | EIP-DLRMVE | AE-VGFD-LK | -T-V-KLPND | 200 |
| Lead-cDNA-ID24374230 | LEGMELTMER | LLTLINDVYK | YVDSVVGGQI | APDNNIGRFI | ADAVASLPKL | 250 |
| CeresClone:1507510 | MEGMELTLER | LLTLINDVYK | YVDSVVEGQR | LPDNNIGRFI | AEAVASLPKL | 246 |
| gi|50931081 | LEGMESSMEK | LYVLLDEIYK | YVDDVVEGRV | APDNKIGRFI | SDAVASMPKL | 241 |
| CeresClone:500887 | LEGMESSMEK | LYILIDEIYK | YVDDVVEGRV | APDNRIGRV | SESVASMPKL | 244 |
| Consensus | LEGME---ME- | L---LI----YK | YVD-VVEG-V | APDN-IGRFI | --AVAS-PKL | 250 |

Figure 14 (Continued)

| | | | | | |
|---|---|---|---|---|---|
| Lead-cDNA-ID24374230 | PPQVFDNLVN | DSLQDQLLLL | YLSSITRTQL | SLAEKLNTAA | QML | 293 |
| CeresClone:1507510 | PPQVFDNLVN | DSLQDQLLLL | YLSSITRTQL | SLAEKLNTAA | QML | 289 |
| gi|50931081 | SPAAFDKLFN | DRIQDNLALV | YLSSITRTQI | SIAEKLNTAA | QIL | 284 |
| CeresClone:500887 | SPAAFDKLFN | DKIQDNLALV | YLSSITRTQI | SIAEKLNTAA | QAL | 287 |

Consensus      -P--FD-L-N  D--QD-L-L-  YLSSITRTQ-  S-AEKLNTAA  QML   293

Figure 15

| | | | | | | |
|---|---|---|---|---|---|---|
| gi\|55296678 | | | | | | 0 |
| CeresClone:525385 | MEHDECISCG | GFIGFKRNQV | IDCSSEIGDS | DIEELFEINL | KEKEPLADA | 50 |
| Lead-cDNA:ID4950532 | ---------- | ---MQRR--- | ---SNEIEEE | EEQ------- | -EDGRRRLES | 23 |
| gi\|28394029 | ---------- | ---MQRR--- | ---SNEIEEE | EEQ------- | -EDGRRRLES | 23 |
| Consensus | | | ---MQRR--- | ---SNEIEEE | EEQ------- | -EDGRRRLES | 50 |

| | | | | | | |
|---|---|---|---|---|---|---|
| gi\|55296678 | ---------- | ---------- | ---------- | ---------- | ---------- | 0 |
| CeresClone:525385 | REDCEISTV | FSLDDLHDG | G--SGNDDV | VYVAVGKDGD | SSMEALSWAL | 98 |
| Lead-cDNA:ID4950532 | VRES------ | QLEGRSS | GTVSMNGEDN | VYVGVGK-GD | SIKSIE---- | 57 |
| gi\|28394029 | VRES------ | QLEGRSS | GTVSMNGEDN | VYVGVGK-GD | SSMEALRWAI | 63 |
| Consensus | VRES------ | ---QLEGRSS | GTVSMNGEDN | VYVGVGK-GD | SSMEAL-WA- | 100 |

| | | | | | | |
|---|---|---|---|---|---|---|
| gi\|55296678 | KHAVTPSATV | C--VHVFPQV | KLIPSPLGKI | ---------M | PKSQASPEQV | ETYMNQERSK | 21 |
| CeresClone:525385 | ---------- | ---------- | ---------- | ---------- | PRSHVNLEFV | NMHLTQEKGK | 147 |
| Lead-cDNA:ID4950532 | DNLMTSSTL | LFLIHVFPET | RFIPYPLGRI | ---------- | TRERASQEQV | ESFMSQEREK | 57 |
| gi\|28394029 | ---------- | ---------- | ---------- | ---------- | ---------- | ---------- | 113 |
| Consensus | ----T-S-T- | ---HVFP--- | --IP-PLG-I | ---------- | PRS-AS-EQV | E--M-QER-K | 150 |

| | | | | | | |
|---|---|---|---|---|---|---|
| gi\|55296678 | RRVMLQKYLD | HCRNEQVNVD | VYLIESDHVT | EQV------- | NATLELIPVF | HVQQLVLGVS | 71 |
| CeresClone:525385 | RKLLLQKFIT | LCMVDSKVKVE | MKLIEGDNVA | KITIVDLVGNL | NIRKLVLGIT | 197 |
| Lead-cDNA:ID4950532 | RRTLLKFLH | EQVKVKVE | TILVESDSVA | ---------- | KAVQDLITIL | NIRKLVLGID | 93 |
| gi\|28394029 | ---------- | ACSASKVKVE | TILVESDSVA | ---------- | KAVQDLITIL | NIRKLVLGID | 163 |
| Consensus | RR-LLQKFLD | -C--S-VKVE | -IL-ESDSVA | -EQV------ | KA--DLITIL | NIRKLVLGI- | 200 |

| | | | | | | |
|---|---|---|---|---|---|---|
| gi\|55296678 | KSKLRK--FK | RGNTIACGVQ | K--NAPLYCEV | KIVCDGKEVT | TVPTADPTPP | 118 |
| CeresClone:525385 | KSNLRKSGSR | SHNSIAIAKVL | K--NAQESCDI | KIICEGREVL | DQMSDCISP | 245 |
| Lead-cDNA:ID4950532 | KSNARKASTM | KGNSVPELIM | RSSAADVCEV | KVICQGKEIN | MEQTMMESSP | 143 |
| gi\|28394029 | KSNARKASTM | KGNSVPELIM | RSSAADVCEV | KVICQGKEIN | MEQTMMESSP | 213 |
| Consensus | KSN-RKAST- | KGNS--E--M | -S-AADVCEV | K-ICQGKE-N | MEQT---E-SP | 250 |

Figure 16

```
                                                                          41
                                                                          48
                                                                          45
                                                                          43
gi|30577630       ---MEASRAEG  KRSFMEEEED  QEEEEEEEEL  ------KREM  STSSSRRASG
CeresClone:538817 ---MDGSWSEG  KRSMSYKEED  EYEEEEEEEV  SEYGDDGKKK  RVVSNKRGSK
Lead-CeresClone10375 MSMRRSKAEG  KRSLRELSEE  EEEEEETED-  ---EDTFEE  EEALEKKQKG
gi|1183866        ---MDTSKGEG  KRVLKLPGSQ  EQGEEEDDI-  ---GEDSKKT  RALT-PSGKR 50
Consensus         ---MD-SKAEG  KRS---E-EED  EEEEEEEEEL  ---GED-K--  R--S-KRG--

91
                                                                          98
                                                                          95
                                                                          93
gi|30577630       SGGSTPPTCQ  VENCNADLTD  AKHYHRRHKV  CESHAKAPIV  YVAGGQKRFC
CeresClone:538817 AGGSVPPSCQ  VDGCNADLSE  AKPYHRRHKV  CEYHAKAPAN  VIGDQHQRFC
Lead-CeresClone10375 KATSSSGVCQ  VESCTADISK  AKQYHKRRHKV CQFHAKAPHV  RISGLHQRFC
gi|1183866        ASGSTQRSCQ  VENCAAEMTN  AKPYHRRHKV  CEFHAKAPVV  LHSGLQQRFC 100
Consensus         A-GSTPPTCQ  VENCNADL--  AKPYHRRHKV  CEFHAKAP-V  -ISGL-QRFC 134
                                                              138
                                                              131
                                                              131
gi|30577630       QQCSRFHDLS  EFDEYKKSCR  KRLAGHNERR  RKSSSDFHRE  GSN
CeresClone:538817 QQCSRFHELS  EFDDSKRSCR  RRLAGHNERR  RKNASEYHGL  ---
Lead-CeresClone10375 QQCSRFHALS EFDEAKRSCR  RRLAGHNERR  RKSTTD----  ---
gi|1183866        QQCSRFHELS  EFDEAKRSCR  RRLAGHNERR  RKSSLDTH--  ---

143
Consensus         QQCSRFHELS  EFDEAKRSCR  RRLAGHNERR  RKSSSD-H--  ---
```

Figure 17

```
Lead-CeresClone108509  MD-SRRES-- ----KTEASS REKRIYEKDQ MNQESFIEGL AEEFRLPITH  44
CeresClone:764678      MERPGHGG-- ---TGSGGGS KNPPPSCKDE YGGGYDRLDE EVEFRLPRGH  45
CeresClone:333416      MESKQWCKTP QEVGAGCGR QV-------- -------DLEEDD LEEFRLPMGH  39
Consensus              ME-----G-- ----G-GGGS ---------- ----D-ED-- -EEFRLP-GH  50

Lead-CeresClone108509  RVTENVDLED VEQASLDVKI SSSNVGFRLL QKMGWKLGKG LGKQEQGILE  93
CeresClone:764678      RPVENLDTEG LEQASVDTRL ASSNVGFRLL QKMGWKSGKG LGKNEQGILE  95
CeresClone:333416      RPTENLDTEG LQQASVTQL TASNVGFRLL QKMGWKTGKG LGKNEQGILE  89
Consensus              RPTENLDTEG LEQASVDT-L -SSNVGFRLL QKMGWK-GKG LGKNEQGILE  100

Lead-CeresClone108509  PIKSGIRDRR LGLGKQEEDD YFTAEENIQR KKLDIEIEET EELAKKREVL  143
CeresClone:764678      PIKAGIRDAK LGVGKQEEDD FFTAEDNVQR KRLNVELEET EEHIKKREVI  145
CeresClone:333416      PIRADMRDAK LGVGKQEEDD FFTSEENVQR KKLNIELEET EEHIKKREVI  139
Consensus              PIKAGIRDAK LGVGKQEEDD FFTAEENVQR KKLNIELEET EEHIKKREV-  150

Lead-CeresClone108509  AEREQKIQSD VKEIRKVFYC ELCSKQYRLV MKFEGHLSSY DHNHKKRFKE  193
CeresClone:764678      AEREQKIRSE VKEIQKTFFC SLCNKQYKLA YEFESHLSSY DHNHRKRFKE  195
CeresClone:333416      AEREHKIRSE VKEIQKVFFC NLCNKQYKLA HEFESHLSSY DHNHRKRFKE  189
Consensus              AEREQKIRSE VKEIQKVFFC -LCNKQYKLA -EFESHLSSY DHNHRKRFKE  200

Lead-CeresClone108509  MKEMH--GAS GRDDRKKREQ QRQEREMLKM ADARKQHQMQ QSQQEVPENV  241
CeresClone:764678      MKEMQSGGSG NRDDRQKREQ QREEKELAKF AQLADAHRKQ QKEKQEQPDI  245
CeresClone:333416      MREMQS-SSG SRDDRQKREQ QREEKELAKI AQLADAHRKQ QKDKQEKSET  238
Consensus              MKEMQS-GSG -RDDRQKREQ QREEKELAK- AQLADAHRKQ QK-KQE----  250

Lead-CeresClone108509  PVSAPAKTTV APLAVQDQRK TLKFGFSISKS GIISKSQPTS KKPKVA----  289
CeresClone:764678      SGEQATSKNL PTPGNQDQRR TLKFGFSKMT P--SKAPVGS MSKKPKIATK  293
CeresClone:333416      --EDAAPKNM AASNQDQRQ TLKFGFSKMA P--SKVLVGS ASKKPKVATK  284
Consensus              --E-AA-KN- A----NQDQR- TLKFGFSKM- P--SK--VGS -SKKPKVATK  300
```

```
Lead-CeresClone108509    ASVFGNDSD ED-    301
CeresClone:764678        VPSVFGNDSD EEA   306
CeresClone:333416        VSSVFGNESD EDS   297

Consensus                V-SVFGNDSD ED-   313
```

```
gi|50900102        MARRGTEAFP  DLGAQCDRED  CNQLDFLPFD  CDGCGKTFCA  EHRTYRDHGC   50
CeresClone:592400  MASGGTEAFP  DLGKHCQHRD  CNQLDFLPFT  CDGCQQLFCL  EHRSYKSHAC   50
Lead-CeresClone11130  MAGGGTEAFP  DLGEHCQDPD  CKLLDFLPFT  CDGCKLVFCL  EHRSYKSHNC   50
gi|11994583        MAGGGTEAFP  DLGEHCQDPD  CKLLDFLPFT  CDGCKLVFCL  EHRSYKSHNC   50

Consensus          MAGGGTEAFP  DLGEHCQDPD  C--LDFLPFT  CDGCK-VFCL  EHRSYKSHNC   50 gi|50900102        ARAADQGRTV  VVCEACCDAI  ERRAGDGGGD  DAAVLEAHAR  SRRCDPARKR  100
CeresClone:592400  LKSDHNSRKV  VVCEACSMSI  E--TGHVGQD  EEAILQKHLK  SGNCDPTKKK   99
Lead-CeresClone11130  PKSDHGSRTV  SICETCSIAI  E--TGFDERG  KSLLEKHER  SGDCDPNKKK   99
gi|11994583        PKSDHGSRTV  SICETCSIAI  E--TGFDEKG  KSLLEKHER  SGDCDPNKKK   99

Consensus          PKSDHGSRTV  --CE-CSIAI  E-TTGFD---  -K-ILEKHER  SGDCDPNKKK  100 gi|50900102        KPRCPVPRCK  ETLTFSNTSG  CKGCGQKVCL  KHRFPADHAC  AGAGAGAASI  149
CeresClone:592400  KPLCPVKRCR  EVLTFSNTST  CKTCHIKVCL  KHRFPADHAC  SRGASASSSA  149
Lead-CeresClone11130  KPTCPVKRCK  EILLTFANNLT  CKDCGVKFCL  KHRFPTDHVC  NKKTNTAG-  148
gi|11994583        KPTCPVKRCK  EILLTFANNLT  CKYCGVKFCL  KHRFPTDHVC  NKKINTAG-  148

Consensus          KPTCPVKRCK  EVLTF-N---  CK-CGVK-CL  KHRFP-DH-C  NKK--NTA--  150 gi|50900102        ----------  --KA        AGAAAARSA   GQCGRDAQKK  EGGGWKLPQS  VRNMKLF    188
CeresClone:592400  CVSNGLWNNR  FLTAFAKRTG  QECAKNGATF  S-----TSPPS  TPSVKAY    192
Lead-CeresClone11130  --TRSRWNER  FMEALSLRNQ  KGCGRGSSVS  S----KSP--  -AISVRSF   186
gi|11994583        --TSSRWNER  FMEALSLRNQ  KGCGRGSSVS  S----KSS--  -PSVRSF    186

Consensus          ---T-SRWNER  FMEAL-LRNQ  K-CGR-SSVS  S------KSP-S  --PSV-SF   197
```

Figure 19

```
CeresClone:894637      -MYSPKPESS FGPNPNSGTH QQQMELTGAN MGPGNGAN--  -NNTNMAGRQ   46
gi|50725048            ---------- ---------- ---MELGGNN MGPDNGAN--  -NNSNLAARQ   24
Lead-CeresClone115924  ---------- ---------- MEADNGG--- -PNSSHASKQ   16
CeresClone:477003      MYHSKNVPSA SLIGGNSLSH GQHDCGGST MDPGSGGNGL  SNNSNLTSKQ   50

Consensus              ----S----- -S-------H ---------- M-P-NG-N--  -NNSNMAS-Q   50

CeresClone:894637      RLRWTNELHE RFVEAVTQLG GPDRATPKGV LRIMGVQGLT  YHVKSHLQK    96
gi|50725048            RLRWTNELHE RFVEAVTQLG GPDRATPKGV LRIMGVQGLT  YHVKSHLQK    74
Lead-CeresClone115924  RLRWTHELHE RFVDAVAQLG GPDRATPKGV LRVMGVQGLT  YHVKSHLQK    66
CeresClone:477003      RLRWTHELHE RFVDAVAQLG GPDRATPKGV LRVMGVQGLT  YHVKSHLQK   100

Consensus              RLRWT-ELHE RFV-AV-QLG GPDRATPKGV LR-MGVQGLT  IYHVKSHLQK  100

CeresClone:894637      YRLAKYIPDA STD-GNKTDN KDPGDLLAGL EGSSGLQISE  ALKLQMEVQK  145
gi|50725048            YRLAKYIPDS SAD-GNKAEN KDPGDLLAGL EGSSGLQISE  ALKLQMEVQK  123
Lead-CeresClone115924  YRLAKYLPDS SSE-GKKTDK KESGDMLSGL DGSSGMQITE  ALKLQMEVQK  115
CeresClone:477003      YRLAKYLPDS SSDEGKKADK KETGDMLSNL DGSSGMQITE  ALKLQMEVQK  150

Consensus              YRLAKY-PDS SSD-G-K-D- K--GD-L-GL -GSSG-QI-E  ALKLQMEVQK  150

CeresClone:894637      RLHEQLEVQR QLQLRIEAQG KYLQKIIEEQ QRLTGVKSET  PAGGASVTVS  195
gi|50725048            RLHEQLEVQR QLQLRIEAQG KYLKKIIEEQ QRLCGVKSET  PAAGASVTLP  173
Lead-CeresClone115924  RLHEQLEVQR QLQLRIEAQG KYLKKIIEEQ QRLSGVLGE-  ---PSAPMT   160
CeresClone:477003      RLHEQLEVQR QLQLRIEAQG KYLKKIIEEQ QNLSGVLSEA  PGSGAMVP    200

Consensus              RLHEQLEVQR QLQLRIEAQG KYLKKIIEEQ QRLSGV-SET  PA-GAS-TV-  200

CeresClone:894637      SDQFPDSE-R TEPSTPAPAS RDTCDRTEAT  KSTCHGDSLS  244
gi|50725048            SDQFPDSE-R TDPSTPAPTS RDNGGQNEAT  KSPQRDDSLS  222
Lead-CeresClone115924  GD-------- SDPATPAPTS DKSGKDCGPD  KSLSVDESLS  197
CeresClone:477003      GDACQEPDNK TDPSTPDP-- EKAAKDRAPA  KSLSI-ESFS  237

Consensus              -DQFPDSE-R TDPSTPAPTS ---GK--E-T  KSLS-D-SLS  250
```

```
CeresClone:894637      RN-EPLTPDS  NCQNGSPVAS  PNHERAAKRQ  RGS-GTEFLD  SEAEFSLPRH  292
gi|50725048            RH-EPLTPDS  NCQPGSPTAS  PKHERAAKRQ  RGN-GAEF--  SETDFALPHS  268
Lead-CeresClone115924  SYREPLTPDS  GCNLGSPDES  TGEERLSKKP  RLVRGAAG--  YTPDFVVGHP  245
CeresClone:477003      SHPEPMTPDS  GCHVGSPAES  PKGERSAKKQ  RXNHG-----  -------WC   274

Consensus              -H-EPLTPDS  -C---GSP--S  PKHERAAK-Q  RGN-GAEF--  SE-DF-LPH-  300

CeresClone:894637      FESSSGSEF   QQYSMSYSGQ   ----------  ----------  ----------  312
gi|50725048            FESSSGSEF   QQCSMSYSGH   ----------  ----------  ----------  288
Lead-CeresClone115924  LESGLNTSY   HQSDHVLAFD   QPSTSLLGAE  EQLDKVSGDN  L           286
CeresClone:477003      VF-------   ----------   ----------  ----------  ----------  276

Consensus              FESSSGSEF   QQ-SMSYSG-   ----------  ----------  ----------  341
```

| | | | | |
|---|---|---|---|---|
| CeresClone:634320 | MSD—GGGEP | ———GSA | ———— | PVCNFVQKP— | —PKNI RKRPA | 32 |
| gi\|50907243 | MADGGGGEA | ———GSG | ———— | PVCSFVRKP— | —PKNI RKRPT | 34 |
| Lead-CeresClone117089 | MSD———SGEP | KPSQQEEPLP | QPAAQETQSQ | QVCTFFKKPT | KSKNI RKRT—— | 45 |
| CeresClone:478779 | MED———SDQP | AKS——— | ——AENQQTE | QVCSFFRKPV | NKKNI RKR——— | 35 |
| Consensus | MSD——G—GEP | G———— | ————A———S | —VCSF—RKP— | —PKNI RKRP— | 50 |

| | | | | | |
|---|---|---|---|---|---|
| CeresClone:634320 | ASVGSDDEEG | SGGDDSCAI A | AARSKKPPPT | TSKLFFSSAD | N——————S | 74 |
| gi\|50907243 | APAGSDDDDE | DG———SCAI A | AARAKKAPSS | TSKLFFSSAD | G——————S | 73 |
| Lead-CeresClone117089 | TI DADEEDG | DSKSESSI LQ | NLKKVAKPD— | —SKLYFSSGP | SKSSTTT——S | 90 |
| CeresClone:478779 | TI VNEDNEE | DSNNETSLLH | I QKKTLKPD— | —NKLYFSTGS | SKSSAAEPS | 82 |
| Consensus | ATVGSDDE—— | D———ES———A | AA——KKKPD— | TSKL—FSS—D | SKSS———S | 100 |

| | | | | | |
|---|---|---|---|---|---|
| CeresClone:634320 | HEPRR———FQF | ESSRTI QST | DNRATATLET | ETAYDRDARA | I REROLKQAE | 122 |
| gi\|50907243 | SEPRR———FQY | ESSRTI QAST | DSRATATLET | ETEFDRDARA | RERLKQAE | 121 |
| Lead-CeresClone117089 | GAPERSVFHY | DSSKEI QVQN | DSGATATLET | ETDFNQDARA | RERVLKKAD | 140 |
| CeresClone:478779 | EEPGKPVFQF | ESSKEI QVQH | DSKATATLET | ETEFSKDARA | RERALKQAE | 132 |
| Consensus | —EPRR—VFQ— | ESS——I Q——— | DSRATATLET | ETEFDRDARA | I RERQLKQAE | 150 |

| | | | | | |
|---|---|---|---|---|---|
| CeresClone:634320 | ESLKKNPSAS | SS————SGE | LYKGI HGYTD | HKAGFRREHT | VSGEKAGGAH | 167 |
| gi\|50907243 | ESLKKNPSAP | ASSGSGSGE | VYKGI HGYTD | YKAGFRREHT | VSSEKAGGSH | 171 |
| Lead-CeresClone117089 | EALKGNKKA | SF————DEK | LYKGI HGYTD | HKAGFRREQT | SSEKAGCSH | 184 |
| CeresClone:478779 | ESLKGKSPSS | K————NEK | LYKGMNSYKD | YKAGFRREQT | ASEKAGGSH | 176 |
| Consensus | ESLK—NPSAS | SS———S——— | LYKGI HGYTD | —KAGFRRE—T | —SSEKAGGSH | 200 |

| | | | | | |
|---|---|---|---|---|---|
| CeresClone:634320 | GPLRASAHI R | LSLRFDYQPD | CKDYKETGY | CGYGDSCKFM | HDRGDYKSGW | 217 |
| gi\|50907243 | GPLRASAHI R | LSARFDYQPD | CKDYKETGY | CGYGDSCKFM | HDRGDYKSGW | 221 |
| Lead-CeresClone117089 | GPLRASAHI R | VSARFDYQPD | CKDYKETGY | CGYGDSCKFL | HDRGDYKPGW | 234 |
| CeresClone:478779 | GPLRASAHI R | VSARFDYQPD | CKDYKETGY | CGYGDSCKFM | HDRGDYKSGW | 226 |
| Consensus | GPLRASAHI R | —SARFDYQPD | I CKDYKETGY | CGYGDSCKFM | HDRGDYKSGW | 250 |

Figure 20 (Continued)

```
CeresClone:634320      QLEREWDEAE  KARKRRIAMR  ELGGSDCEAE  EEDSDDEEAL  PFACFICREP   267
gi|50907243            QIEKEWEEAE  KARKRRIAMG  GDGSDYEAGE  EDDDDEEAL   PFACYICREP   271
Lead-CeresClone117089  QIEKEWEEAE  KVRKRNKAMG  VE-DEDDEAD  KDSDEDENAL  PFACFICREP   283
CeresClone:478779      QMEKEWEEAE  KARKMRLAAG  ED-ADEEGAN  LTDEDDEDSL  PFACFICRNT   275

Consensus              QIEKEWEEAE  KARKRRIAMG  EDG-DDEEAE  EDDDDDEEAL  PFACFICREP   300

CeresClone:634320      FVDPVVTKCK  HYFCEHCALK  HHSKNKKCFV  CNKPTLGIFN  AAQEIRKKIA   317
gi|50907243            FVDPVVTKCK  HYFCEHCALK  HHSKNKKCFV  CNKPTLGIFN  AAQEIRKKMA   321
Lead-CeresClone117089  FVDPVVTKCK  HYFCEHCALK  HHTKNKKCFV  CNQPTMGIFN  AAHEIKKRMA   333
CeresClone:478779      FVDPVVTKCK  HYFCEHCALK  HHAKNKKCFV  CNQPTLGIFN  VAHEIRRKMA   325

Consensus              FVDPVVTKCK  HYFCEHCALK  HHSKNKKCFV  CN-PTLGIFN  AA-EIRKKMA   350

CeresClone:634320      QDKKQQDL---                                                 325
gi|50907243            QDKKQ------                                                 326
Lead-CeresClone117089  EERSKAEEGL                                                  343
CeresClone:478779      EDKS-------                                                 329

Consensus              --DK-Q-----                                                 360
```

Figure 21

| | | | | | |
|---|---|---|---|---|---|
| Lead-CeresClone119104 | ------- | -MDDLHG- | ------- | ------- | -RMHI GVAQN | 18 |
| gi\|53792087 | ------- | MSHHDGSK | PYQPRRGPER | DAAA-HVAPTV | DHLAAVAAEA | 46 |
| CeresClone:337006 | ------- | MSHHDGSK | PYQPRRGPER | PPPAAVAPSV | EHLVAAAAEA | 48 |
| CeresClone:220709 | MSH-HHDGSK | PYQPRRGPER | SPQPADGI AV | PPPAAVAPSV | EHLVAAAAEA | 50 |

Consensus: --MSHHDGSK PYQPRRGPER -PQPADGI A- PPPAAVAPSV EHLVAAAAEA   50

| | | | | | |
|---|---|---|---|---|---|
| Lead-CeresClone119104 | PMHVQYEDH- | ------- | ------- | ENGMMD---- | DHADGGMQE | 49 |
| gi\|53792087 | EAMARFEEEH | RAL---GAEEE | YEEEEDELEE | EEEEME---- | EDEDAQHHE | 89 |
| CeresClone:337006 | EALNRFAAEQ | QQQL QGHEQE | VGEEEEEDE- | QEDEME--EE | DEDEHEGQHG | 96 |
| CeresClone:220709 | EALSRLGAEQ | QQLL QGHEHE | VG-EEEGEDE | EEDEMEDDD | DDDEQEGQHG | 99 |

Consensus: EAM-RFE-EQ QQLLQGHE-E VGEEEEE-DE EEDEME---- D-DEDEGQH-   100

| | | | | | |
|---|---|---|---|---|---|
| Lead-CeresClone119104 | GVETD---PS | HPG------ | ----NSADNR | GEVVD---RG | E---NGDQLTL | 82 |
| gi\|53792087 | GV GGE-AVPM | DAEAA---- | AQLDPH | CGMLA-SGAV | QPMASNQLTL | 130 |
| CeresClone:337006 | GI GGE-HVPM | DADAAAAAAA | AAV -SQMDPH | SALVA---GTV | PPMATNQLTL | 142 |
| CeresClone:220709 | GI GVE-HVPM | DADAAAAAAV | AAAGAQMDPH | SVLVP---GTV | PPMATNQLTL | 146 |

Consensus: G-GGE-HVPM DADAAAAAA- AA--AQMDPH --LVA--GTV -PMATNQLTL   150

| | | | | | |
|---|---|---|---|---|---|
| Lead-CeresClone119104 | SFQGQVYVFD | RVSPEKVQAV | LLLLGGREVP | HTLP--TTLG | SPHQNNRGLS | 130 |
| gi\|53792087 | SFQGEVYVFD | SVSPDKVQAV | LLLLGGRELN | PGL GSGASSS | APY------ | 173 |
| CeresClone:337006 | SFQGEVYVFD | SVSPDKVQAV | LLLLGGRELS | SLSG--ASSS | APY------ | 183 |
| CeresClone:220709 | SFQGEVYVFD | SVSPDKVQAV | LLLLGGRELS | SLSG--ASSS | APY------ | 187 |

Consensus: SFQGEVYVFD SVSPDKVQAV LLLLGGRELS SLLG--ASSS APY------   200

| | | | | | |
|---|---|---|---|---|---|
| Lead-CeresClone119104 | GTPQRLSVPQ | RLASLLRFRE | KRKGRNFDKT | RYTVRKEVA | LRMQRKKGQF | 180 |
| gi\|53792087 | ---SKRLNFPH | RVASLMRFRE | KRKERNFDKK | RYSVRKEVA | LRMQRNRGQF | 221 |
| CeresClone:337006 | ---SKRLNYPH | RVASLMRFRE | KRKERNFDKK | RYSVRKEVA | LRMQRNRGQF | 231 |
| CeresClone:220709 | ---SKRLNFPH | RVASLMRFRE | KRKERNFDKK | RYNVRKEVA | LRMQRNRGQF | 235 |

Consensus: ---SKRLNFPH RVASLMRFRE KRKERNFDKK I RYSVRKEVA LRMQRNRGQF   250

Figure 21 (Continued)

```
Lead-CeresClone119104  TSAKSSNDD-  SGSTGSDWGS  NQSWA-VEGT  ETQKPEVLCR  HCGTSEKSTP  228
gi|53792087            TSSKPKGDEI- ATSELTASDG  SPNWGSVEGR  PPSAAE---CH HCGINAKATP  268
CeresClone:337006      TSSKPKPDEI  AASEMASADG  SPNWALVEGR  PPSAAE---CH HCGTNATATP  279
CeresClone:220709      TSSKPKPDEI  AASEMAAADG  SLNWALVEGR  PPSAAE---CH HCGINATATP  283

Consensus              TSSKPKPDEI  AASEMAAADG  SPNWALVEGR  PPSAAE---CH HCG-NA-ATP  300

Lead-CeresClone119104  MMRRGPDGPR  TLCNACGLMW  ANKGTLRDLS  KV-PPPQTPQ  HLSVNKNEDA  277
gi|53792087            MMRRGPDGPR  TLCNACGLMW  ANKGMLRDLS  KAPPTPIQV-  ---MASVNDG  314
CeresClone:337006      MMRRGPDGPR  TLCNACGLMW  ANKGLLRDVT  KS-PVPLQA-  TQSAPHLDGG  327
CeresClone:220709      MMRRGPDGPR  TLCNACGLMW  ANNGLLRDLS  KS-PVPLHS-  QQSAPILNGG  332

Consensus              MMRRGPDGPR  TLCNACGLMW  ANKGLLRDLS  KS-PVPLQ--  -QS-P-LN-G  350

Lead-CeresClone119104  N---------  -LEADQMMEV  TGDISNTQ--                         277
gi|53792087            NCSA-AAPIT  EQEIPAPATV  NGHESST---                         295
CeresClone:337006      NGSAMSAPGS  ELENAAAAMT  NGHESSSSGV                         340
CeresClone:220709      NGSAMSALGS  ELENAAAAMG  NGHEPSGSGV                         357
                                                                                  362

Consensus              NGSAMSAPGS  ELENAAAAMV  NGHESSTSGV                         380
```

Figure 22

| | | | | | | |
|---|---|---|---|---|---|---|
| Lead-CeresClone120947 | MPSFAFGSHH | HLANPTDSPP | YSVEISIDGD | SSDLDSLSQV | DLESGGVPAP | 50 |
| gi\|9759231 | MPSFAFGSHH | HLANPTDSPP | YSVEISIDGD | SSDWDSLSQV | DLESGGVPAP | 50 |
| Consensus | MPSFAFGSHH | HLANPTDSPP | YSVEISIDGD | SSD-DSLSQV | DLESGGVPAP | 50 |

| | | | | | | |
|---|---|---|---|---|---|---|
| Lead-CeresClone120947 | EKQLHSGGKK | RRTRRRKRRK | KKKKKGGRD | CRICHLPLET | NKEAEDEDEE | 100 |
| gi\|9759231 | EKQLHSGGKK | RRTRRRKRRK | KKKKKGGRD | CRICHLPLET | NN-------- | 92 |
| Consensus | EKQLHSGGKK | RRTRRRKRRK | KKKKKGGRD | CRICHLPLET | N-EAEDEDEE | 100 |

| | | | | | | |
|---|---|---|---|---|---|---|
| Lead-CeresClone120947 | EEDDSDDDED | EEDEEEEEE | EEYYGLPLQL | GCSCKGDLGV | AHSKCAETWF | 150 |
| gi\|9759231 | EEDDSDDDED | ---------- | ----GLPLQL | GCSCKGDLGV | AHSKCAETWF | 118 |
| Consensus | EEDDSDDDED | EEDEEEEEE | EEYYGLPLQL | GCSCKGDLGV | AHSKCAETWF | 150 |

| | | | | | | |
|---|---|---|---|---|---|---|
| Lead-CeresClone120947 | KIKGNMTCEI | CGAMALNVAG | EQSNPESTAS | THSQAAAGQS | LTQTEPRGIW | 200 |
| gi\|9759231 | KIKGNMTCEI | CGAMALNVAG | EQSNPESTAS | TISQAAAGQS | LTQTEPRGIW | 168 |
| Consensus | KIKGNMTCEI | CGAMALNVAG | EQSNPESTAS | THSQAAAGQS | LTQTEPRGIW | 200 |

| | | |
|---|---|---|
| Lead-CeresClone120947 | HGRPVMNFLL | AAMVFAFVVS | WLFHFKVLK | 229 |
| gi\|9759231 | HGRPVMNFLL | AAMVFAFVVS | WLFHFKVLK | 197 |
| Consensus | HGRPVMNFLL | AAMVFAFVVS | WLFHFKVLK | 229 |

| | | | | | | |
|---|---|---|---|---|---|---|
| Lead-CeresClone12997 | MAVEARHMNL | FSSQYITNRE | CVKSQTNMNN | GQQIAGGGFP | LTIGDRN--- | 47 |
| CeresClone:465893 | MAVEAHRLLL | AGGHRQQQQQ | ---------- | QQLASAGWP | WAGADEDRCA | 39 |
| Consensus | MAVEA----L | ---------- | CVKSQTNMNN | GQQ-A---G-P | ----D--RCA | 50 |

| | | | | | | |
|---|---|---|---|---|---|---|
| Lead-CeresClone12997 | ---------- | ---------- | ---LQY | IDPINSFNKS | ESELTAISKR | 70 |
| CeresClone:465893 | TTARPSQHHH | HQQQPQQEL | RLHNASCVGV | LAPRVSTIAA | GGQMFLGDAA | 89 |
| Consensus | TTARPSQHHH | HQQQPQQEL | RLHNASC--- | ---P---S-- | ---------- | 100 |

| | | | | | | |
|---|---|---|---|---|---|---|
| Lead-CeresClone12997 | QRDSTFDSDA | LIASQKRRAI | AFSPASLIDA | E---------| ---LVSQ | 105 |
| CeresClone:465893 | ESDVTFGGGG | AAARQEVTAV | APAPKRRKRA | EQQQTPPVFQ | VCAADDVAAQ | 139 |
| Consensus | ---D--TF-- | --A--Q---- | A----P---- | EQQQTPPVFQ | VCAADD----Q | 150 |

| | | | | | | |
|---|---|---|---|---|---|---|
| Lead-CeresClone12997 | IQQQNSEIDR | FVAQQTETLR | IELEARQRTQ | TRMLASAVQN | AILKKLKAKD | 155 |
| CeresClone:465893 | FQQHIVDVNR | LVFQQTANMW | AALTELRRRQ | ARQVVAAVEA | AAATRLRARE | 189 |
| Consensus | --Q-------R | ---V--QQT-- | ---L-----R-Q | -R----AV-- | A------L-A-- | 200 |

| | | | | | | |
|---|---|---|---|---|---|---|
| Lead-CeresClone12997 | EEIIRMGKLN | WVLQERVKNL | YVENQIWRDL | AQTNEATANN | RSNLEQVLA | 205 |
| CeresClone:465893 | EEVQRTARIN | GTLEERARSL | YVEAQLWRDL | ARANEATANE | LRAELQQAL- | 238 |
| Consensus | EE--R----N | --L--ER---L | YVE-Q-WRDL | A--NEATAN- | LR--L-Q--LA | 250 |

| | | | | | | |
|---|---|---|---|---|---|---|
| Lead-CeresClone12997 | QVDDLDAFRR | PLV-EEADDA | ESSCGSCDGG | DVTAVVNGGC | KRCGQLTASV | 254 |
| CeresClone:465893 | --DDQRTRGA | PGAGADADDA | GSCCRGGEDG | GTGTSLARTC | XVXGLSAADV | 286 |
| Consensus | QVDD------ | P---G---ADDA | -S-C-----G | ---------C | K--CG---A-V | 300 |

| | | | | |
|---|---|---|---|---|
| Lead-CeresClone12997 | LVLPCRHLCL | CTVCGSSALL | RTCPVCDMVM | TASVHVNMSS | 294 |
| CeresClone:465893 | LLLPCRHLCA | CAPCAGAA-- | RACPACGCAK | NGSVCVNFS- | 323 |
| Consensus | L--LPCRHLC- | C--C----ALL | R-CP-C---- | --SV-VN-SS | 340 |

Figure 25

| | | | | | | |
|---|---|---|---|---|---|---|
| Lead-CeresClone14234 | MGLWDSLLNW | LRSLFFKQEM | ELSLVGLQNA | GKTSLVNAIA | TGGYSEDMIP | 50 |
| CeresClone:567499 | MGLWDSLLNW | LRSLFFKQEM | ELSLVGLQNA | GKTSLVNSIA | TGGYSEDMIP | 50 |
| gi|50912455 | MGLWDSLLNW | LRSLFFKQEM | ELSLVGLQNA | GKTSLVNAVA | TGGYSEDMIP | 50 |
| CeresClone:361163 | MGLWDSLLNW | LRSLFFKQEM | ELSLVGLQNA | GKTSLVNAVA | TGGYSEDMIP | 50 |

Consensus    MGLWDSLLNW  LRSLFFKQEM  ELSLVGLQNA  GKTSLVNA-A  TGGYSEDMI P    50

| | | | | | | |
|---|---|---|---|---|---|---|
| Lead-CeresClone14234 | TVGFNMRKVT | KGNVTIKIWD | LGGQRRFRTM | WERYCRGVSA | VYVIDAADR | 100 |
| CeresClone:567499 | TVGFNMRKVT | KGNVTIKLWD | LGGQRRFRTM | WERYCRGVTA | LYVVDAADR | 100 |
| gi|50912455 | TVGFNMRKVT | KGNVTIKLWD | LGGQRRFRTM | WERYCRGVSA | LYVVDAADR | 100 |
| CeresClone:361163 | TVGFNMRKIT | KGNVTIKLWD | LGGQRRFRTM | WERYCRGVSA | LYVVDAADR | 100 |

Consensus    TVGFNMRKVT  KGNVTI KLWD  LGGQRRFRTM  WERYCRGVSA  I LYVVDAADR   100

| | | | | | | |
|---|---|---|---|---|---|---|
| Lead-CeresClone14234 | DSVPISRSEL | NDLLTKPSLN | GIPLLILGNK | DKSEALSKQ | ALVDQLGLES | 150 |
| CeresClone:567499 | DSVPIAKSEL | HDLLTKQSLS | GIPLLILGNK | DKSEALSKP | ALVDQLGLES | 150 |
| gi|50912455 | DSIPIAKSEL | HDLLTKQSLA | GIPLLVLGNK | DKSEAVSKQ | ALVDQLGLEL | 150 |
| CeresClone:361163 | DSIPIAKSEL | LDLLTKQSLA | GIPLLVLGNK | DKSEALSKQ | ALVDQLGLEL | 150 |

Consensus    DS-PIAKSEL  HDLLTKQSLA  GIPLL-LGNK  IDKSEALSKQ  ALVDQLGLE-   150

| | | |
|---|---|---|
| Lead-CeresClone14234 | VTDREVCCYM | ISCKDSINID | AVIDWLIKHS | RTAT | 184 |
| CeresClone:567499 | KDREVCCYM | ISCKDSVNID | VVIDWLIKHS | KTAN | 184 |
| gi|50912455 | KDREVCCYM | ISCKDSVNID | VVIDWLIKHS | RTAK | 184 |
| CeresClone:361163 | KDREVCCYM | ISCKDSVNID | VVIDWLIKHS | RTAK | 184 |

Consensus    I KDREVCCYM  I SCKDSVNI D  VVI DWLI KHS  RTAK    184

Figure 26

```
                                                                          46
CeresClone:1537388   MATAAAAVAA                    TFRTLIQHAA  ACGA----PVP  LPSVRFQSLQ  -RHRVGLRRL
gi|3550485           ----MATAVV                    AFRSFLHPTA  TAAA--IPLP  PSHFNLNNFQ  -GHCIGLR--   41
gi|50934311          -----MAAV                     AFRSLLHPAA  AALTERVPLP  PAHLRLQGLH  -RHRVGVLNL   43
Lead-CeresClone14246 -MSSAYCSSA                    VAVSAAATAS  SAATFNPLLS  SHSNSQLFYR  FTPKSFKLVA   49
CeresClone:511197    -----MAAV                     SSSICNRIYN  LSFT-HPSLS  LTTCNFRQRP  ISQKPFTLNL   43
gi|311952            ----MSVAA                     TASTCSTSSL  YLFTQKPKFS  VEHLSLSTYN  -AHFNFKINS   44
gi|20005             MSGCCFSFAA                    TASTSSTSLL  YLFTQKPKFS  VDHLSLSTYN  -THFNFKINS   49

Consensus            -----SAAA    -A-----S----  -A--T--P-LS  ---HLNL--Y-  ---H--F-LN-   50

CeresClone:1537388   APP-------  ---RGRPVLT    PPFAAEDFSS   YVDDFSGDDG   EHFDEEE---   84
gi|3550485           -------LFS  SHRSHPI--LP   ASASAASGQE   FSSD--GEYY   S--EEYVEEE   80
gi|50934311          -------FVA  SGHRRRL--LP   LAAAGGEFSS   EEEEYANEEE   EEGEEYVEEE   86
Lead-CeresClone14246 NCPNPLILHS  NIRRHRFF---   -CAAETEASS   ADDEIQASVE   EEEEVEEE-V   94
CeresClone:511197    KSQSFTLSFF  PLHR-----LP   PPSAAFDGFE   VAQDTTEFQQ   D--EPETEPV   87
gi|311952            TKLKAHFPIS  SLYRSSIFLS    TCASVSDGVE   VVQE---DDEE   E--VALSAEE   90
gi|20005             TKLKAHFPIS  SLYRSSIFLS    TCASVSDGVE   VVQE---DDEE   E--VALSAEE   95

Consensus            ---------S  SL--R---L-    --AA-SDG-E   ----D---DDEE  E---E---EEE  100

CeresClone:1537388   GSEPEEEAE-  ----APRAYSS  PRSRPPRGDD   PGRLFVGNLP   YTYTSEELAQ   130
gi|3550485           GEEAEPEVE-  ----AVRGYYP  PRNRPAL-GQE  PGRIYVGNLP   YTFTAAELTA   126
gi|50934311          EEDGEEEAA   AVAAPRGYYP   PRSRPAL-GQE  PGRLFVGNLP   YTMTSGEISQ   136
Lead-CeresClone14246 GDGEEEVE-   -------E    EKQTTQASGE   EGRLYVGNLP   YTITSSELSQ   134
CeresClone:511197    EKTEQEEEQ-  --------    -KVSDSYD    AGRLYVGNLP   YSITNSALAE   123
gi|311952            EEEIEEKEE-  --------    -SVESESVE   GGRLYVGNLP   FSMTSSQLSE   127
gi|20005             EEEIEEKEE-  --------    -RVESESVE   GGRLYVGNLP   FSMTSSQLSE   132

Consensus            EEE-EEEEEE  ---------    -RSR-S-S-E   -GRLYVGNLP   YTMTSSELS-   150
```

Figure 26 (Continued)

```
CeresClone:1537388  VFSEAGRVDD  AQIIYDKVTN  RSRGFAFVTM  ATAEEAAKAI  QMFDGALLGG  180
gi|3550485          AFSEAGSVDD  VQIIYDKITD  RSRGFAFVTM  ATAEEAAKAV  QMFNGALLGG  176
gi|50934311         TFSEAGRVDN  VQIIYDKVTD  RSRGFAFVTM  ATAEEAATAI  QMFNGALLGG  186
Lead-CeresClone14246 LFGEAGTVVD  VQIVYDKVTD  RSRGFGFVTM  GSIEEAKEAM  QMFNSSQIGG  184
CeresClone:511197   LFGEAGTVAS  VEIMYDRVTD  RSRGFAFVTM  GNVEDAKEAI  RMFDGSQVGG  173
gi|311952           IFAEAGTVAN  VEIVYDRVTD  RSRGFAFVTM  GSVEEAKEAI  RLFDGSQVGG  177
gi|20005            IFAEAGTVAN  VEIVYDRVTD  RSRGFAFVTM  GSVEEAKEAI  RLFDGSQVGG  182

Consensus           IFSEAGTV--  VQI-YDKVTD  RSRGFAFVTM  G-VEEAKEAI  QMFDGSQ-GG  200

CeresClone:1537388  RTARVNYPEV  PRGGERRTVT  MSG-RRR---  -DDGTYKIYA  GNLGWGVRAD  225
gi|3550485          RTVRVNFPEV  PRGGERAVAS  AAVARTSLRV  VDDGTYKVYA  GNLGWGVRAD  226
gi|50934311         RTARVNYPEV  PRGGERAVGS  AAATRENRR-  -DDGTFKIYA  GNLGWGVRAD  234
Lead-CeresClone14246 RTVKVNFPEV  PRGGENEVMR  TKI-RDNNRS  YVDSPHKVYA  GNLGWNLTSQ  233
CeresClone:511197   RTVKVNFPEV  PKGGERLVMG  SKI-RNSYRG  FVDSPHKIYA  GNLGWGLTSQ  222
gi|311952           RTVKVNFPEV  PRGGEREVMS  AKI-RSTYQG  FVDSPHKLYV  ANLSWALTSQ  226
gi|20005            RTVKVNFPEV  PRGGEREVMS  AKI-RSTYQG  FVDSPHKLYV  ANLSWALTSQ  231

Consensus           RTVKVNFPEV  PRGGER-VMS  AKI-RN--R-  FVDSPHKIYA  GNLGWGLTSQ  250

CeresClone:1537388  TLRNMFEGRA  GLLDARVIFE  RETGRSRGFG  FVSFSTAEDA  QAALESLDGV  275
gi|3550485          ALKTAFEGQP  GLVGARVIFE  RDTGRSRGFG  FVSFHTQDA   KAALQAMDGV  276
gi|50934311         ALRAAFEGQP  GLLDARVIFE  RDSGRSRGFG  FVSFRTAEDA  QAALEALDGV  284
Lead-CeresClone14246 GLKDAFGDQP CVLGAKVIYE  RNTGRSRGFG  FISFESAENV  QSALATMNGV  283
CeresClone:511197   GLREAFAEQP  CVLSAKVIYE  RDSGRSRGFG  FVSFETAESA  QAALDLMNGV  272
gi|311952           GLRDAFADQP  GFMSAKVIYD  RSSGRSRGFC  FITFSSAEAM  KSALDTMNEV  276
gi|20005            GLRDAFADQP  GFMSAKVIYD  RSSGRSRGFG  FITFSSAEAM  NSALDTMNEV  281

Consensus           GLRDAF-DQP  GLL-AKVIYE  R-TGRSRGFG  FVSF-TAE-A  QAAL--MNGV  300
```

Figure 26 (Continued)

```
CeresClone:1537388   ELEGRPLRLS LAEQNPPPGS PIPSTAQQQE ETDSGAPAGA GTE---AASS   322
gi|3550485           ELDGRPLRLS LAAQNPPAGS TPSTAQSQQE KTASRG-SEA EPQVDNNTIT   325
gi|50934311          ELEGRPLRLS MAEQNP-TAG SPSTVQSQEE ETASES-SDA ETE---QSIT   329
Lead-CeresClone14246 EVEGRALRLN LASEREKPTV SPPSVEEGET E---------  ----------   314
CeresClone:511197    EVQGRPLRLN LAEARA-P-S SPPVIQKNV- ----------  ----------   299
gi|311952            ELEGRPLRLN VAGQKA-PLS SPSVVETSP- ----------  ----------   304
gi|20005             ELEGRPLRLN VAGQKA-PVS SPPVVETSP- ----------  ----------   309

Consensus            ELEGRPLRLN LA-Q---P-S SPSTVQ---- E---------  ----------   350

CeresClone:1537388   SEPSEAEVGE SNLQTAANY                                       341
gi|3550485           SGQFGGEMEK SNLQATASY                                       344
gi|50934311          SEPSEAETEE SNLQTAASY                                       348
Lead-CeresClone14246 ----EASLES NEVLSNVSA                                       329
CeresClone:511197    ----GSNVES SELVSSAST                                       314
gi|311952            ----ENDSEN NELLSSLSS                                       319
gi|20005             ----ENDSDN SELLSSLSS                                       324

Consensus            ----E--VE- SELLSSASS                                       369
```

Figure 27

| | | | | | | |
|---|---|---|---|---|---|---|
| gi\|50872446 | MGRAPCCDKA | SVKKGPWSPE | EDAKLKSYIE | QNGTGGNWIA | LPQKIGLKRC | 50 |
| Lead-CeresClone154718 | MGRAPCCDKA | NVKKGPWSPE | EDAKLKSYIE | NSGTGGNWIA | LPQKIGLKRC | 50 |
| gi\|2832408 | MGRAPCCDKA | NVKKGPWSPE | EDAKLKSYIE | NSGTGGNWIA | LPQKIGLKRC | 50 |
| Consensus | MGRAPCCDKA | NVKKGPWSPE | EDAKLKSYIE | NSGTGGNWIA | LPQKIGLKRC | 50 |
| gi\|50872446 | GKSCRLRWLN | YLRPNIKHGG | FSEEEDRIL | SLYISIGSRW | SIIAAQLPGR | 100 |
| Lead-CeresClone154718 | GKSCRLRWLN | YLRPNIKHGG | FSEEEENIIC | SLYLTIGSRW | SIIAAQLPGR | 100 |
| gi\|2832408 | GKSCRLRWLN | YLRPNIKHGG | FSEEEENIIC | SLYLTIGSRW | SIIAAQLPGR | 100 |
| Consensus | GKSCRLRWLN | YLRPNIKHGG | FSEEEENIIC | SLYLTIGSRW | SIIAAQLPGR | 100 |
| gi\|50872446 | TDNDIKNYWN | TRLKKKLFGK | QSRKDQR--- | QQQHLARQAA | AAASDLQIKQ | 147 |
| Lead-CeresClone154718 | TDNDIKNYWN | TRLKKKLINK | QRKELQEACM | EQQEMMVMMK | RQHQQQQIQT | 150 |
| gi\|2832408 | TDNDIKNYWN | TRLKKKLINK | QRKELQEACM | EQQEMMVMMK | RQHQQQQIQT | 150 |
| Consensus | TDNDIKNYWN | TRLKKKLINK | QRKELQEACM | EQQEMMVMMK | RQHQQQQIQT | 150 |
| gi\|50872446 | EASRGANEAD | GLAAGANYTW | H-HHHAMAVP | VHPMSAPMVV | EGGRVGDDVD | 196 |
| Lead-CeresClone154718 | SFMMRQDQ-- | ------TMFTW | PLHHHNVQVP | ALFMNQTNSF | CDQE----DVK | 190 |
| gi\|2832408 | SFMMRQDQ-- | ------TMFTW | PLHHHNVQVP | ALFRIKPTRF | ATKK---MLS | 190 |
| Consensus | SFMMRQDQ-- | ------TMFTW | PLHHHNVQVP | ALFM--P---F | ------DV- | 200 |
| gi\|50872446 | ESTRKLLFKL | CGNPEAASPA | PPCIPPPPMY | EEAPSFVPPL | ----AHGVPLN | 243 |
| Lead-CeresClone154718 | PVLIKNMVKI | EDQELEKTNP | HHHQDSMTNA | FDHLSFSQLL | LDPNHNHLGS | 240 |
| gi\|2832408 | QCSSSRTWSRS | KIKNWRKQTS | SSSRFN-DNA | FDHLSFSQLL | LDPNHNHLGS | 239 |
| Consensus | ---K---K-- | ---------- | ----------NA | FDHLSFSQLL | LDPNHNHLGS | 250 |
| gi\|50872446 | EGCMQCSSVL | ------PALE | L-DENFHFNH | VKLDGLECLF | GM------CDH | 281 |
| Lead-CeresClone154718 | GEGFSMNSIL | SANTNSPLLN | TSNDNQWFGN | FQAETVNLFS | GASTSTSADQ | 290 |
| gi\|2832408 | GEGFSMNSIL | SANTNSPLLN | TSNDNQWFGN | FQAETVNLFS | GASTSTSADQ | 289 |
| Consensus | GEGFSMNSIL | SANTNSPLLN | TSNDNQWFGN | FAETVNLFS | GASTSTSADQ | 300 |

```
                              QNMRWNEVSP LVCPNNAVAS SSQGMQQYCL VEEPADLGMQ    321
gi|50872446        STISWEDISS LVYSDS---- ------KQFF- ----------    310
Lead-CeresClone154718  STISWEDISS LVYSDS---- ------KQFF- ----------    309
gi|2832408

Consensus          STISWEDISS LVYSDS---- ------KQFF-                 340
```

| | | | | | |
|---|---|---|---|---|---|
| Lead-CeresClone158155 | FRLNWASFST | GEKRA----- | VENGPDLSVF | VGDLSPDVTD | VLLHETFSDR | 225 |
| CeresClone:1361871 | FRLNWASFST | CEKRA----- | SENGPDLSIF | VGDLAPDVSD | AVLLETFAGR | 236 |
| CeresClone:621732 | FRLNWATFSA | GERRS----- | SDATSDLSIF | VGDLAIDVTD | AMLQDTFAGR | 217 |
| gi|40804404 | FRLNWSAFSS | GEKRADVGAG | AGSGSDLSIF | VGDLASDVTD | TMLRDTFSSR | 201 |
| gi|9663769 | FRLNWAGFST | GEKRA----- | ETGSDFSIF | VGDLASDVTD | TMLRDTFASR | 200 |

Consensus    FRLNWASFST  GEKRA-----  SE-GSDLSIF  VGDLA-DVTD  -MLRDTFA-R    250

| | | | | | |
|---|---|---|---|---|---|
| Lead-CeresClone158155 | YPSVKSAKVV | IDSNTGRSKG | YGFVRFGDEN | ERSRALTEMN | GAYCSNRQMR | 275 |
| CeresClone:1361871 | YPSVKGAKVV | IDSNTGRSKG | YGFVRFGDEN | ERSRAMTEMN | GAFCSSRQMR | 286 |
| CeresClone:621732 | YSSIKGAKVV | IDSNTGRSKG | YGFVRFGDEN | ERTRAMTEMN | GVYCSSRPMR | 267 |
| gi|40804404 | YPSVKGAKVV | IDSNTGRSKG | YGFVRFDDES | ERSRAMTEMN | GIYCSSRAMR | 251 |
| gi|9663769 | YPSLKGAKVV | VDANTGHSKG | YGFVRFGDES | ERSRAMTEMN | GVYCSSRAMR | 250 |

Consensus    YPSVKGAKVV  IDSNTGRSKG  YGFVRFGDEN  ERSRAMTEMN  GVYCSSR-MR    300

| | | | | | |
|---|---|---|---|---|---|
| Lead-CeresClone158155 | VGIATPKRAI | ANQQQHSSQA | VILAGGHGSN | GSMGYGSQSD | GESTNATIFV | 325 |
| CeresClone:1361871 | VGIATPKRAA | AYCQQNGSQA | LTLAGGHGGN | GSM---SD | GESNNSTIFV | 331 |
| CeresClone:621732 | GIVATPKKTY | GFQQYSSQA | VVLAGGHSAN | GAVAQCSHSE | GDLNNTIFV | 317 |
| gi|40804404 | IGVATPKKPS | PM-QQYFPQA | VILAGGHASN | GAATQTSQTD | SDLSNTTVFV | 300 |
| gi|9663769 | IGVATPKKPS | AH-EQYSSQA | VILSGGYASN | GAATHGSQSD | GDSSNTIFV | 299 |

Consensus    IGVATPKK-S  A---QQYSSQA  VILAGGHASN  GAM--GSQSD  GDS-NTTIFV    350

| | | | | | |
|---|---|---|---|---|---|
| Lead-CeresClone158155 | GGIDPDVLDE | DLRQPFSQFG | EVVSVKIPVG | KGCGFVQFAD | RKSAEDAIES | 375 |
| CeresClone:1361871 | GGLDADVTEE | DLMQPFSDFG | EVVSVKIPVG | KGCGFVQFAN | RQSAEEAIGN | 381 |
| CeresClone:621732 | GGLDSDTSDE | DLRQPFLQFG | EVVSVKIPAG | KGCGFVQFAD | RKNAEEAIQG | 367 |
| gi|40804404 | GGLDSEVTDE | ELRQSFSQFG | NVVSVKIPAG | KGCGFVQFSE | RSAAEDAIEK | 350 |
| gi|9663769 | GGLDSEVTDE | ELRQSFNQFG | EVVSVKIPAG | KGCGFVQFSD | RSSAQEAIQK | 349 |

Consensus    GGLDSDVTDE  DLRQPFSQFG  EVVSVKIPVG  KGCGFVQFAD  RKSAEEAI--    400

Figure 28 (Continued)

```
Lead-CeresClone158155  LNGTVI GKNT  VRLSWGRSP-  NKQWR DSGQ  QWNGGYSRGH  GYNN GGYAN  424
CeresClone:1361871     LNGTVI GKNT  VRLSWGRSP-  NKQWRSDSGN  QWNGGYSRCQ  GYNNGY---A  427
CeresClone:621732      LNGTVI GKQT  VRLSWGRSPG  NK HWRSDS--  --NGGHYGGH  QGY GGHGFAV  413
gi|40804404            LNGTVI GAQT  VRLSWGRNPA  NKQFRTDSGS  QWNGGYY-GR  QNY GGYGYGA  399
gi|9663769             LSGAI I GKQA  VRLSWGRSPA  NKQMRTDSGS  QWNGGYN-GR  QNY GGYGYGA  398

Consensus              LNGTVI GKQT  VRLSWGRSP-  NKQWR-DSGS  QWNGGYS-GR  Q-YGGYGY--A  450

Lead-CeresClone158155  HH DSNNY---  ---HGEN---  ----------  ----------  ----------  435
CeresClone:1361871     NQDSN MYATA  AAAV PGAS--  ----------  ----------  ----------  445
CeresClone:621732      RQNQDL AMQP  AAAI QGAS--  ----------  ----------  ----------  431
gi|40804404            SQSQDS-MYG   AGAA HGASSN  GYGNHEQSVS  ----------  ----------  428
gi|9663769             SQNQDSGMYA   TGAAY GASSN  RYGNHQQPVS  ----------  ----------  428

Consensus              --Q-QDS-M--  A-A--HGAS--  ----------  ----------  ----------  480
```

Figure 29

```
CeresClone:1459706    MDAAARKRSR  PESANG----  AAGGKRSRES  ESQQTGLSSK  SKPCTKFFST   47
CeresClone:703717     MD-AGRKRAV  PEGAN-----  GAAVKRARES  ESVQTGVGSK  SKPCTKFFST   45
gi|50905911           MEVGGRKRGK  PDGA------  GAGGKRARES  ESFQTGVGSK  SKPCTKFFST   45
CeresClone:473410     MD---IRKRGR  PEPGFSL---N  GGFKKSKQEM  ESLSTGVGSK  SKPCTKFFST   46
CeresClone:975540     MD---TRKRAG  SFNSNGGGGG  GGSKKSKQEM  ESYSTGLGSK  SKPCTKFFST   48
Lead-CeresClone17632  MD---TRKRGR  PEAGSFNSNG  GGYKKSKQEM  ESYSTGLGSK  SKPCTKFFST   48
gi|9294110                    -M  -----------  AADTRSLSKM  ESYSTGLGSK  SKPCTKFFST   31

Consensus             MD---RKR-R   PE-AN-----G  GA--KS--EM  ESYSTGLGSK  SKPCTKFFST   50

CeresClone:1459706    VGCPFGEGCH  FAHFVPGGYQ  AVSKSHSLGH  AAVSAPSR--  ----APADH    90
CeresClone:703717     AGCPFGSSCH  FLHNFPGGHQ  AVSKMTNLGG  PAVSAPQGRM  PMGPGVPDGP   95
gi|50905911           SGCPFGEGCH  FLHHFPGGYN  AVAKMTNLGG  PAIAPPPGRM  PMGNAVPDGP   95
CeresClone:473410     AGCPFGEGCH  FLHYVPGGYN  AVAHMMNLTP  AAPLPPTRNV  AALPHVPNGS   96
CeresClone:975540     SGCPFGDNCH  FLHYVPGGYN  AVAQLTNMAL  PMP-QASRNM  Q-------GP   90
Lead-CeresClone17632  SGCPFGENCH  FLHYVPGGYN  AVSQMTNMGP  PIP-QVSRNM  Q--------    88
gi|9294110            SGCPFGENCH  FLHYVPGGYN  AVSQMTNMGP  PIP-QVSRNM  Q--------    71

Consensus             SGCPFGENCH  FLHYVPGGYN  AVS-MTNMG-  PAP--PSRNM  -------P-G  100

CeresClone:1459706    AASGVKTRMC  TKYNTAEGCK  FGDKCHFAHG  ERELGRPPSS  YMSQESSYAP  140
CeresClone:703717     PTPSLKTRLC  NKFNTAEGCK  WGNKCHFAHG  ERELGKP---  -MLLNNSMAP  141
gi|50905911           PTPTVKTRLC  NKYNTAEGCK  WGDKCHFAHG  ERELGKP---  -MLMDSSMPP  141
CeresClone:473410     APSAVKTRIC  NKFNTAEGCK  FGDKCHFAHG  EWELGKHIAP  SFDDHRAMGP  146
CeresClone:975540     ----------  ----------  ----------  ----------  -------GG    92
Lead-CeresClone17632  ----------  ----------  ----------  ----------  -------GS    90
gi|9294110            ----------  ----------  ----------  ----------  -------GS    73

Consensus             -----VKTRLC  -K-NTAEGCK  -GDKCHFAHG  E-ELGK----  -------S-GP  150
```

Figure 29 (Continued)

| | | | | | | | |
|---|---|---|---|---|---|---|---|
| CeresClone:1459706 | PMGGRYGGR- | -HEPPLPASM | GPPAGNFGAS | STCKVSVDAA | LAGGIIGKGG | | 188 |
| CeresClone:703717 | PMGPRPNGH- | FQPPPMPGPD | MVPPSTFGAS | ATAKISVDAS | LAGAIIGKGG | | 190 |
| gi|50905911 | PMGPRPTGH- | FAPPPMPSPA | MSTPASFGAS | ATAKISVDAS | LAGGIGRGG | | 190 |
| CeresClone:473410 | PGAGRLAGR- | -MEPP----- | -PAASFGAN | STAKISVEAS | LAGAIIGKGG | | 188 |
| CeresClone:975540 | GGGGRFSGRG | GESGP----- | -CHVSSFGAS | ATAKISVDAS | LAGAIIGKGG | | 136 |
| Lead-CeresClone17632 | GNGGRFSGR- | GESGP----- | -CHVSNFGDS | ATARFSVDAS | LAGAIIGKGG | | 133 |
| gi|9294110 | GNGGRFSGR- | GESGP----- | -CHVSNFGDS | ATARFSVDAS | LAGAIIGKGG | | 116 |
| Consensus | P-GGRFSGR- | -E-PP----- | -G---S-FGAS | ATAKISVDAS | LAGAIIGKGG | | 200 |
| CeresClone:1459706 | VNTKQICRIT | GVKLSIRDHE | SNPDLKNIEL | EGSFDQIKQA | NDMVRDLIAS | | 238 |
| CeresClone:703717 | VNTKHISRMT | GAKLAIRDNE | ADPNHKNIEL | EGSFDQVNHA | SAMVKELILR | | 240 |
| gi|50905911 | VNTKQISRVT | GAKLSIRDHE | SDTNLKNIEL | EGSFDQIKNA | SAMVRELIVS | | 240 |
| CeresClone:473410 | VNSKQICRQT | GAKLSIQDHE | SDPNLRNIEL | EGSFEQIKEA | SNMVKDLLLT | | 238 |
| CeresClone:975540 | VSSKQICRQT | GVKLSIQDHE | RDPNLKNIVL | EGTFEQINEA | SVMVRELIGR | | 186 |
| Lead-CeresClone17632 | VSSKQICRQT | GAKLSIQDHE | RDPNLKNIVL | EGTLEQISEA | SAMVKDLIGR | | 183 |
| gi|9294110 | VSSKQICRQT | GVKLSIQDHE | RDPNLKNIVL | EGTLEQISEA | SAMVKDLIGR | | 166 |
| Consensus | VNTKQICRQT | GAKLSIRDHE | SDPNLKNIEL | EGTFDQI-EA | SAMVKDLI-R | | 250 |
| CeresClone:1459706 | SASTPSKNP | ASAAAPAGRG | GGGGGGGPGG | RSNYKTKICE | NFLKGTCTFG | | 288 |
| CeresClone:703717 | GGNA----PP | -QAKNPGRG | PAGGGG---- | GSNFKTKLCD | NFNKGSCTFG | | 281 |
| gi|50905911 | GGGA----PP | -QGKKPVGG | SHRGGG---P | GSNFKTKLCE | NFTKGSCTFG | | 282 |
| CeresClone:473410 | QMSA----PP | -KTTPGVPG | APASHG---- | -SNFKTKLCE | NFAKGSCTFG | | 278 |
| CeresClone:975540 | LNSAASRRXP | -GGGGLGG | GVGSEGKPHP | RFAKGNCTFG | | | 234 |
| Lead-CeresClone17632 | LNSAA--KKPP | -GGGLGGG | GMGSEGKPHP | GSNFKTKICE | RFSKGNCTFG | | 230 |
| gi|9294110 | LNSAA--KKPP | -GGGLGGG | GMGSEGKPHP | GSNFKTKICE | RFSKGNCTFG | | 213 |
| Consensus | LNS-A---KPP | ---G---GGGG | G-GS-G-P-P | GSNFKTK-CE | NF-KG-CTFG | | 300 |

Figure 29 (Continued)

| | | | |
|---|---|---|---|
| CeresClone:1459706 | ERCHFAHGET | EQRKGAAV | 306 |
| CeresClone:703717 | DRCHFAHGES | ELRKSAAA | 299 |
| gi|50905911 | DRCHFAHGEN | ELRKSAAA | 300 |
| CeresClone:473410 | DRCHFAHGAS | ELRKSGV- | 295 |
| CeresClone:975540 | DRCHFAHGEA | ELRRSGIA | 252 |
| Lead-CeresClone17632 | DRCHFAHGEA | ELRKSGIV | 248 |
| gi|9294110 | DRCHFAHGEA | ELRKSGIV | 231 |
| | | | |
| Consensus | DRCHFAHGE- | ELRKSGV- | 318 |

Figure 30

```
                                                                              50
gi|50919203       MHRSAGATMA  WNVFRFCTAL  RGLGSIMILL  VLSIVGVTYY  AVVVYNYGPA  50
CeresClone:230342 MYRSAGVAMA  WNVFRFCTAL  RGLGSIMILL  VLAIVGVTYY  AVVLCNYGPA  50
CeresClone:537080 MYRS-GAGMA  WNVFRFCTAL  RGLGSIMILM  VLGVVGVTYY  AVVLTNFGPA  49
Lead-CeresClone19340 MHRS-GITMA WNVFKFCTAL RGLGSIMILL VLGVVGVTYY AVVLTNYGPP  49
CeresClone:573293 MHRS-GATMA  WNVFKFCTAL  RGLGSIMILL  VLGVVGATYY  AVVLTNYGPA  49

Consensus         MHRS-GATMA  WNVFRFCTAL  RGLGSIMILL  VLGVVGVTYY  AVVLTNYGPA  50 gi|50919203       LFAGGASILL  ALVLLLFHF   LLVMLLWSYF  SVVFTDPGSV  PPNWNLDFDE  100
CeresClone:230342 LFTGGGTILA  ALAVLLSFHF  LLAMLLWSYF  SVVFTDPGSV  PPNWNLDFDV  100
CeresClone:537080 LFLGGLDTLI  SFVVLILFHC  LLVMLLWCYF  AVVFMDPGTV  PPNWKPAADE  99
Lead-CeresClone19340 LSQGGLDSLA ALTLILFHF  LLAMLLWSYF  SVVFTDPGMV  PPNWRPSTDE  99
CeresClone:573293 LYAGGLDSLV  ALAVLILFHS  LLVMLLWSYF  SVVFTDPGSV  PPNWKPTIDE  99

Consensus         LF-GGLDTL-  AL-VLILFHF  LLVMLLWSYF  SVVFTDPGSV  PPNWKP--DE  100 gi|50919203       ERGETAPLSG  LDFNSQVNSQ  QSIAHNDTGH  PRARYCRKCN  QMKPPRCHHC  150
CeresClone:230342 EMGETAPLAS  SELCSQMNSQ  QSVALGNMTN  PRVRYCRKCN  QLKPPRCHHC  150
CeresClone:537080 ERGEVDPLNG  VELSNLQSDP  --AN------  QRFRYCRKCS  QPKPPRCHHC  141
Lead-CeresClone19340 ERGESDPLNS LDFVGLQSDS --SN------ PRVRFCRKCN QLKPSRCHHC  143
CeresClone:573293 ERGEADPLVG  TEFSNLPSDP  -SS-------  PRVRYCRKCN  QLKPPRCHHC  140

Consensus         ERGE-DPL-G  LEFS-L-ND-  --S-------  PRVRYCRKCN  QLKPPRCHHC  150 gi|50919203       SVCGRCVLKM  DHHCVWVVNC  VGALNYKYFL  LFLFYTFLET  TLVTLSLLPH  200
CeresClone:230342 SVCGRCVLKM  DHHCVWVVNC  VGALNYKYFL  LFLFYTFLET  TLVTLSLLPH  200
CeresClone:537080 SVCGRCVLKM  DHHCVWVVNC  VGALNYKYFL  LFLFVTFLET  TLVTISLLPH  191
Lead-CeresClone19340 SVCGRCVLKM DHHCVWVVNC VGALNYKYFL LFLFYTFLET TLVTLMPH   193
CeresClone:573293 SVCGRCVLKM  DHHCVWVVNC  VGALNYKYFL  LFLFYTFLET  TLVTASLLPH  190

Consensus         SVCGRCVLKM  DHHCVWVVNC  VGALNYKYFL  LFLFYTFLET  TLVTLSLLPH  200
```

Figure 30 (Continued)

| | | | | | | | |
|---|---|---|---|---|---|---|---|
| gi\|50919203 | FI AFFSDI DI | PGSPAALATT | FLTFVLNLAF | SLSVLGFMI M | HVSLVSANTT | | 250 |
| CeresClone:230342 | FI AFFSDAEI | PGSPAALATT | FLTFVLNLAF | SLSVLGFMI M | HI SLVSANTT | | 250 |
| CeresClone:537080 | FKTYFSDGEI | PGTPGTLATT | FLTFVLNLAF | SLSVLGFLVL | HVSLVASNTT | | 241 |
| Lead-CeresClone19340 | FI AFFSDEEI | PGTPGTLATT | FLAFVLNLAF | ALSVMGFLI M | HI SLVAGNTT | | 243 |
| CeresClone:573293 | FI AFFSDGEI | PGTPGSLATT | FLAFVLNLAF | ALSVLGFLI M | HI SLVAANTT | | 240 |

Consensus      FI AFFSD-EI   PGTPG-LATT   FLTFVLNLAF   SLSVLGFMI M   HI SLVAANTT         250

| | | | | | | | |
|---|---|---|---|---|---|---|---|
| gi\|50919203 | TI EAYEKKTT | PRWMYDI GRK | RNFI QVFGND | KRYWFI PAYS | EEDLRRMPVL | | 300 |
| CeresClone:230342 | TI EAYEKKTT | PHMLYDLGRK | RNFAQVFGND | RKYWFI PAYS | EEDLRRTPAL | | 300 |
| CeresClone:537080 | TI EAYEKKTT | SKWRYDLGRR | KNFEQVFGMD | KRYWFI PAYS | EEDI RRMPVL | | 291 |
| Lead-CeresClone19340 | TI EAYEKKTT | TKWRYDLGKK | KNFEQVFGMD | KRYWL PGYT | EEDLRRMPEL | | 293 |
| CeresClone:573293 | TI EAYEKKTT | PKWRYDLGRR | KNFEQVFGMD | KKYWFI PAYS | DEDI RKMPAL | | 290 |

Consensus      TI EAYEKKTT   PKWRYDLGRK   KNFEQVFGMD   KRYWFI PAYS   EEDLRRMP--L        300

| | | | |
|---|---|---|---|
| gi\|50919203 | QGLDYPVRTD | LDGQEL | 316 |
| CeresClone:230342 | QGLDYPVRPD | FDGQEL | 316 |
| CeresClone:537080 | QGLEYPSTPD | FNAQEF | 307 |
| Lead-CeresClone19340 | QGLEYPSKPD | FDSQ-- | 307 |
| CeresClone:573293 | QGLDYPSKPD | FDSQ-- | 304 |

Consensus      QGLDYPS-PD   FDSQE-           316

Figure 31 (Continued)

```
CeresClone:212775      PVIRHPRYKT  EVCRMVLAGV  VCPYGHRCHF  RHSITPAD--  --LFLPRP    318
Lead-CeresClone207419  PVIRHPRYKT  EVCRMIVTGA  MCPYGHRCHF  RHSLTDQERM  MMMMLTR-    311
gi|12597770            PVIRHPRYKT  EVCRMMVTGA  MCPYGHRCHF  RHSLTDQERM  MMMMLTR-    310

Consensus              PVIRHPRYKT  EVCRM-VTGA  MCPYGHRCHF  RHSLTDQERM  MMMMLTR-    348
```

Figure 32

| | | | | | | |
|---|---|---|---|---|---|---|
| CeresClone:1354021 | MASKALI LLG | —————— | LFAI LLVVSE | VSAARQSGMV | KFESEATVQP | EGYHGGHGGH | 50 |
| CeresClone:12459 | MASKALI LLG | —————— | LFAI LLVVSE | VSAARQSGMV | KPESEETVQP | EGYHGGHGGH | 50 |
| CeresClone:3244 | MASKALI LLG | —————— | LFAI LLVVSE | VSAARQSGMV | KPESEETVQP | EGYHGGHGGH | 50 |
| CeresClone:24667 | MASKALI LLG | —————— | LFSVLLVVSE | VSAARQSGMV | KPESEETVQP | EGYGGGHGGH | 50 |
| CeresClone:118184 | MASKALI LLG | —————— | LFSVLLVVSE | VSAARQSGMV | KPESEETVQP | EGYGGGHGGH | 50 |
| Lead-CeresClone207629 | MASKALI LLG | —————— | LFSVLLVVSE | VSAARQSGMV | KPESEETVQP | EGYGGGHGGH | 50 |
| CeresClone:1006473 | MASKALI LLG | —————— | LFSVLLVVSE | VSAARQSGMV | KPESEETVQP | EGYGGGHGGH | 50 |
| Consensus | MASKALI LLG | | LFSVLLVVSE | VSAARQSGMV | KPESEETVQP | EGYGGGHGGH | 50 |

| | | | | | | |
|---|---|---|---|---|---|---|
| CeresClone:1354021 | GGGGHYGGG | HGHGGHNGGG | GHGLDGYGGG | HGGHYGGGG | HYGGGGH——— | ——————— | 98 |
| CeresClone:12459 | GGGGHYGGG | HGHGGHNGGG | GHGLDGYGGG | HGGHYGGGG | HYGGGGH——— | ——————— | 98 |
| CeresClone:3244 | ————GGGG | HGHGGHNGGG | GHGLDGYGGG | HGGHYGGGG | ———GGGGGH | ——————— | 89 |
| CeresClone:24667 | GGHG——GGGG | HGHGGHYGGG | G——GHY GGG | ——GGHYGGGG | GH—GGGGHYG | 93 |
| CeresClone:118184 | GGHG——GGGG | HGHGGHNGGG | GHGLDGYGGG | —GGHYGGGG | HYGGGGHYG | 97 |
| Lead-CeresClone207629 | GGHG——GGGG | HGHGGHNGGG | GHGLDGYG——| ——GHYGGGG | GYGGGGHHG | 94 |
| CeresClone:1006473 | GGHG——GGGG | HGHGGHNGGG | GHGLDGYGGG | —GGHYGGGG | GH—GGGHYG | 96 |
| Consensus | GGHG——GGGG | HGHGGHNGGG | GHGLDGYGGG | —GGHYGGGG | —YGGGGHYG | 100 |

| | | | | | | |
|---|---|---|---|---|---|---|
| CeresClone:1354021 | —GGGGHYGGG | GHHGGG—— | ——CHGLNEPV | QTKPGV | —————— | 127 |
| CeresClone:12459 | —GGGGHYGGG | GHHGGG—— | ——CHGLNEPV | QTKPGV | —————— | 127 |
| CeresClone:3244 | ————————| ——HHGGG—— | ——CHGLNEPV | QTKPGV | —————— | 108 |
| CeresClone:24667 | GGGGGYGGG | GHHGGG—— | ——CHGLNEPV | QTKPGV | —————— | 123 |
| CeresClone:118184 | GGGGHYGGG | GGHGGGGHYG | GGCHGLNEPV | QTKPGV | —————— | 133 |
| Lead-CeresClone207629 | GGGGYGGG | QTKPGV—— | ——————— | —————— | —————— | 110 |
| CeresClone:1006473 | GGGGGYGGG | GHHGGG—— | ——————— | —————— | —————— | 112 |
| Consensus | GGGGY—GGG | GHHGGG—— | ——GHGLNEPV | QTKPGV | | 136 |

Figure 33

```
Lead-CeresClone20769   ------MFGRH SI[P-NNQI]G TASA[SA]GEDH  VSASA[TSGH]  P[YDDME]E]PH   44
CeresClone:477718      MEPSAMYGP[S] QPLNIPSRIG AGER[DDGSG]-  -NE[PAVDGHH]  HHI QYETHAL   48
CeresClone:518521      MEPSAMYG[HS] QPLSMPSQIG GGESDDGSG-    -NE[HAVDGHH]  HHI QYETHAL   48

Consensus              MEPSAMYG-S   QPL--PSQIG -GE-DDGSG-    -NE-AVDGHH   HHI QYETHAL    50

Lead-CeresClone20769   P[DSI YGAASD] L[T PDGSQ]LVA  [HRSDQSELLV]  SRPP[EGANQL]  T[I SFRGQVYV]   94
CeresClone:477718      DDGAA[GGAV]-  VVEDVTSDAV   YVSGGGG----   ---P[EESSQL]  [TLSFRGQVYV]    91
CeresClone:518521      ED[---GAAV]-  VVEDVTSDAV   YVSGGGG----   [PVESSQL]---  [TLSFRGQVYV]    88

Consensus              -D---GAAV-   VVEDVTSDAV   YVSGGGG----   ---PEESSQL   TLSFRGQVYV    100

Lead-CeresClone20769   FDAV[GA]DKVD  AVL[SLLGGS]T  EL[AP]GPQV[ME]  LAQQQN[H]HMPV  VEY[QSRCSLP]  144
CeresClone:477718      FDAVTPDKVQ   AVLLLLGGCE   LSSGGSPCVD   PGAQQNQRGS   MEF--PKCSLP    140
CeresClone:518521      FDAVTPDKVQ   AVLLLLGGCE   LSSGGSPCVD   PGAQ[H]NQRGS  MEF--PKCSLP    137

Consensus              FDAVTPDKVQ   AVLLLLGGCE   LSSGGSPCVD   PGAQQNQRGS   MEF--PKCSLP    150

Lead-CeresClone20769   [QRAQSL]DRFR  KKR[NARCFEK]  KVRY[GVRQEV]  ALR[MARNKGQ]  FTSSK[MI]DGA   194
CeresClone:477718      QRAASLDRFR   QKRKERCFDK   KVRYSVRQEV   ALRMF[RNKCQ]   FTSSKKQDGA    190
CeresClone:518521      [HRAASL]H[R]FR  QKRKERCFDK   KVRYSVRQEV   ALRMHRNKGQ   FTSSKKQDGA    187

Consensus              QRAASLDRFR   QKRKERCFDK   KVRYSVRQEV   ALRMHRNKGQ   FTSSKKQDGA    200

Lead-CeresClone20769   QRAASLDRFR   [QDDA]HPEL]SC  [THCGI SSKC]T  PMMRRGPSGP  R[T]LCNACGLF    244
CeresClone:477718      Y[NS]GTDQDSG  QDDSQSETSC   K[HCGI]SSKST   PMMRRGPSGP   RSLCNACGLF    240
CeresClone:518521      NSYGTDQDSG   QDDSQSETSC   [THCGI SSKST]  PMMRRGPSGP   RSLCNACGLF    237

Consensus              NSYGTDQDSG   QDDSQSETSC   THCGI SSKST   PMMRRGPSGP   RSLCNACGLF    250

Lead-CeresClone20769   [WANRC]L[RDL]  [SKK]EENQ[LA]  L[MKPDDGGSV]  A[DAANNLNTE]  AASVEEH[TSM]   294
CeresClone:477718      WANRGALRDL   SKRNQEHSLP   PVEQVDGGND   [PDCRT]----    AADPAQ[NNL]    285
CeresClone:518521      WANRGALRDL   SKRNQEHSLP   PVEQVD[EGND]  [SDCRT]----    A[T]ADPAHNNL    282

Consensus              WANRGALRDL   SKRNQEHSLP   PVEQVDGGND   -DCRT----    AAADPAHNNL    300
```

Figure 33 (Continued)

```
Lead-CeresClone20769  VSLANGDNSN  LLGDH----  ----       309
CeresClone:477718     AAFSEPVNPA  LVADRKVFQS  QKMLE      310
CeresClone:518521     PAFSEHDNPA  LVADHKVFQS  QKMLK      307

Consensus             -AFSE-DNPA  LVADHKVFQS  QKML-      325
```

Figure 34

```
CeresClone:1100893      MMGSNNPGGA GGGGGM---- ---------- ---------- ---RHDDEAVLTE    37
CeresClone:1052135      ---------- ----M----- ---------- ---------- ---RHDDEAVLTE    22
gi|50726325             MMGSNSAGGG GGGAMVPGGM ---------- ---------- AGG-GGGGDG RHDDEAVLTE    49
Lead-CeresClone208303   ---------- ---------- ---------- ---------- GTGVGGGGDG RHDDEAALTE    21
gi|41529318             ---------- ---------- ---------M ---------- NHN-QQSNEV RHDDENALSD    20
CeresClone:25793        ---------- ---------- ---------M ---------- NHG-QQSGEA KHEDDAALTE    20

Consensus               ---------- ---------- ---------M ---------- ---AM GTG--GG-DG RHDDEA-LTE    50

CeresClone:1100893      FLSSLMDYNP TIPDELVEHY LGRSGFHCPD AM GT G--GG-DG RHDDEA-LTE    87
CeresClone:1052135      FLSSLMDYNP TIPDELVEHY LGRSGFHCPD LRLTRLVAVA AQKFISDIAS    72
gi|50726325             FLSSLMDYTP TIPDELVEHY LGRSGFYCPD IRLTRLVAVA AQKFISDIAS    99
Lead-CeresClone208303   FLSSLMDYTP TIPDELVEHY LGRSGFHCPD LRLTRLVAVA TQKFISDIAS    71
gi|41529318             FLASLTDYTP TIPDELVEHY LAKSGFQCPD VRLTRLVAVA TQKFLSDIAS    70
CeresClone:25793        FLASLMDYTP TIPDDLVEHY LAKSGFQCPD VRLTRLVAVA AQKFVSDIAL    70
                                                                    TQKFVADVAS  70

Consensus               FLSSLMDYTP TIPDELVEHY LGRSGFHCPD LRLTRLVAVA -QKFISDIAS   100

CeresClone:1100893      DSLQHCKARV AAPVKDNKSK QPKDRRLVLT MDDLSKALRE HGVNLKHPEY   137
CeresClone:1052135      DSLQHCKARV AAPIKDNKSK QPKDRRLVLT MDDLSKALRE HGVNLKHPEY   122
gi|50726325             DSLQHCKARV AAPIKDNKSK QPKDRRLVLT MDDLSKALQE HGVNLKHPEY   149
Lead-CeresClone208303   DSLQHCKARV AAPIKDNKSK QPKDRRLVLT MDDLSKALRE HGVNLKHAEY   121
gi|41529318             DALQHCKARQ AAVRDKKEK QQRDKRLIMN MDDLSKALRE YGVNVKHQEY   120
CeresClone:25793        DALQHCKARP APVKDK--K QQKDKRLVLT MEDLSKALRE YGVNVKHPEY   118

Consensus               DSLQHCKARV AAP-KDNKSK QPKDRRLVLT MDDLSKALRE HGVNLKHPEY   150

CeresClone:1100893      FADSPSAGMA PSTREE         153
CeresClone:1052135      FADSPSAGMP PSTREE         138
gi|50726325             FADSPSAGMA PAAREE         165
Lead-CeresClone208303   FADSPSAGMA PSTREE         137
gi|41529318             FADNPSAGLE SAARDE         136
CeresClone:25793        FADSPSTGMD PATRDE         134

Consensus               FADSPSAGMA P-TREE         166
```

Figure 35

| | | | | | | |
|---|---|---|---|---|---|---|
| CeresClone:946808 | MD-FSSPS-P | PMGSGQSPEA | LMEQVQAQLQ | QAYAEELIET | LRGKCFDKCV | 48 |
| CeresClone:1090803 | MDSYSSSS-P | PMGASPSPEA | LMEQI QAQLA | EAYAKELIET | MREKCFDKCI | 49 |
| CeresClone:1086365 | MDSYSSSS-P | PMGASPSPEV | LMEQI QAQLA | EAYAKELIET | MREKCFDKCI | 49 |
| gi|5107082 | MDSYSSPPMG | GSGSSVSPEV | MMESVKTQLA | QAYXEELIET | LRTKCFDKCV | 50 |
| Lead-CeresClone21075 | MDSYSSPPMG | GSGSSVSPEV | MMESVKTQLA | QAYAEELIET | LRTKCFDKCV | 50 |
| gi|14030607 | MDSYSSPPMG | GSGSSVSPEV | MMESVKTQLA | QAYAEELIET | LRTKCLDKCV | 50 |
| CeresClone:584348 | MDSFSNQS-R | GSSSQLSAQD | LKNQLKNQLA | IEYAQQFLET | VGRKCFEKCV | 49 |
| CeresClone:714267 | MDSFSNPS-S | GSSHQLSAHD | LKNQLKNQLA | IEYAQQFLET | VGRKCFEKCV | 49 |
| CeresClone:1323425 | MDSFSSPSMS | SSGSSPNPEA | LMEQI KAQLA | QAYAQEFLET | VGNKCFAKCV | 50 |
| CeresClone:617980 | MDSFSSPSMS | SSGSSPNPEA | LMEQI KAQLA | QAYAQEFLET | VGNKCFAKCV | 50 |
| gi|5107149 | MDSFSS---- | SSGSPPNTEA | LMDQI KAQLA | QAYAQEFLET | VGNKCFAXCV | 46 |
| gi|50251897 | MDSFSS---- | SSGSPPNTEA | LMDQI KAQLA | QAYAQEFLET | VGNKCFAKCV | 46 |
| gi|50928231 | MDSFSSPS-- | SAGSTASIEH | LMEQI KTQLA | QAYAQEFLET | VGNKCFEKCV | 48 |
| CeresClone:373100 | MDSFSSSP-S | SSGPGANPDV | VMEQI KTQLA | QAYAQEFLET | VGNKCFEKCV | 49 |
| CeresClone:392743 | M--------- | ---------- | -EQI KTQLA | QAYAQEFLET | VGNKCFEKCV | 29 |

| Consensus | MDSFSSPS-- | -SGSS-SPE- | LMEQI KAQLA | QAYAQELLET | VG-KCFDKCV | 50 |

| | | | | | | |
|---|---|---|---|---|---|---|
| CeresClone:946808 | TKPGSSLSSG | ESSCVSRCVD | RYI EAMGI VS | RSLFSQQR- | | 86 |
| CeresClone:1090803 | TKPGSSLSSG | ESSCI SRCVD | RYLEATGI -- | RSLFSQQR- | | 87 |
| CeresClone:1086365 | TKPGSSLSSG | ESSCVSRCVD | RYLEATGI -- | RSLFSQQRH | | 88 |
| gi|5107082 | TKPXGSSLCGS | ESSCI SRCVE | RYMEATGI -- | RSLFTQL- | | 87 |
| Lead-CeresClone21075 | TKPGSSLGGS | ESSCI SRCVE | RYMEATGI -- | RSLFTQR- | | 87 |
| gi|14030607 | TKPGSSLGGS | ESSCI SRCVE | RYMEATGI -- | RSLFTQR- | | 87 |
| CeresClone:584348 | TKPGSSMSGS | ESSCI SRCVD | RYI EATGI -- | RSLFSSQ- | | 86 |
| CeresClone:714267 | TKPGSSLSGS | ESSCI SRCVD | RYI EATGI -- | KALFS---- | | 84 |
| CeresClone:1323425 | TKPGSSLSGS | ESSCI SRCVD | RYI EATGI -HR | KALFS---- | | 88 |
| CeresClone:617980 | TKPGSSLSGS | ESSCI SRCVD | RYI EATGI VG | RPGFVQSPL | | 87 |
| gi|5107149 | TKPGTSLSGS | ESSCI SRCVD | RYI EATGI VS | RALFSHR-- | | 84 |
| gi|50251897 | TKPGSSLSGS | ESSCI SRCVD | RYI EATGI VS | RXLFXSTR- | | 84 |
| gi|50928231 | TKPGSSLSGS | ESSCI SRCVD | RYI EATGI VS | RALFSSTR- | | 86 |
| CeresClone:373100 | TKPGSSLSGS | ESSCI SRCVD | RYI EATGI VS | RALFTSQR- | | 87 |
| CeresClone:392743 | TKPGSSLSGS | ESSCI SRCVD | RYI EATGI VS | RALFTSQR- | | 67 |

| Consensus | TKPGSSLSGS | ESSCI SRCVD | RYI EATGI -S | RALFS-QR- | | 89 |

Figure 36 (Continued)

| | | | | | | |
|---|---|---|---|---|---|---|
| Lead-CeresClone21240 | LDM LGFGPLI | PTESERSLME | RVRQELKHEL | KQGYKEKIVD | IREEILRKRR | 347 |
| gi\|1045044 | LDGLGFGPLV | PTESERSLME | RVRQELKHEL | KQGYKEKIVD | IREEILRKRR | 311 |
| gi\|26451634 | LDGLGFGPLV | PTESERSLME | RVRQELKHEL | KQGYKEKIVD | IREEILRKRR | 311 |
| Consensus | LDGLGFGPLV | PTESERSLME | RVRQELKHEL | KQGYKEKIVD | IREEILRKRR | 350 |

| | | | | | | |
|---|---|---|---|---|---|---|
| Lead-CeresClone21240 | AGKLPGDTTS | VLKAWWQSHS | KWPYPTEEDK | ARLVQETGLQ | LKQINNWFIN | 397 |
| gi\|1045044 | AGKLPGDTTS | VLKSWWQSHS | KWPYPTEEDK | ARLVQETGLQ | LKQINNWFIN | 361 |
| gi\|26451634 | AGKLPGDTTS | VLKSWWQSHS | KWPYPTEEDK | ARLVQETGLQ | LKQINNWFIN | 361 |
| Consensus | AGKLPGDTTS | VLKSWWQSHS | KWPYPTEEDK | ARLVQETGLQ | LKQINNWFIN | 400 |

| | | | |
|---|---|---|---|
| Lead-CeresClone21240 | QRKRNWHSNP | SSSTVLKNKR | RSNAGDNSGR | ERFA 431 |
| gi\|1045044 | QRKRNWHSNP | SSSTVSKNKR | RSNAGENSGR | DR-- 393 |
| gi\|26451634 | QRKRNWHSNP | SSSTVSKNKR | RSNAGENSGR | DR-- 393 |
| Consensus | QRKRNWHSNP | SSSTVSKNKR | RSNAGENSGR | DR-- 434 |

Figure 37

```
Lead-CeresClone222894   -MASSNVSTV YISVI DDVIS KVREDFI TY- GMGDAVLNEL QALWEMKMLH        48
gi|39545932             MGTI TTTSAV YI HVI EDVVN KVREEFI NNG GPGESVLSEL QGI WETKMMQ     50
CeresClone:1168684      -MAASTTSQV YI QVI DDVMN KVRDEFVNNG GPGDEVLKEL QSI WESKMMQ       49
Consensus               -MA-STTS-V YI -VI DDV-N KVREEFI NNG GPGD-VL-EL Q-I WE-KMMQ       50

Lead-CeresClone222894   CGAI SGNI DR TKAAAASVGG TTGI TAPVHD LNVPYEAI SE EYAI PTADML      98
gi|39545932             AGVL NGPI ER SSAQKPTPG- ---CPLTI -HD LNVPYEGT-E EYETPTAEML       94
CeresClone:1168684      AGAI VGPI ER SGAPKPTPG- ---GPI TPVHD LNMPYEGT-E EYETPTAEML       95
Consensus               AGAI -GPI ER S-A-KPTPG- ---GP-TPVHD LNVPYEGT-E EYETPTAEML        100

Lead-CeresClone222894   FPPTPLQTPI QTPLPGT-DT -AMYNI PTGP SDYAPSPI SD VRNGMAI NGA        146
gi|39545932             FPPTPLQTPL PI TPLPGTADN SSMYNI PTGS SDY----PTPG TENGVNI ---       138
CeresClone:1168684      FPPTPLQTPL QTPLPGTVDN -SMYNI PTGP SDY----PSAG NEPGANN---       138
Consensus               FPPTPLQTPL QTPLPGT-DN -SMYNI PTGP SDY----P---G -ENG-NI ---      150

Lead-CeresClone222894   DPTAGHPSPY M-PPPSPWMN QR------PLGVD DPDRGVQPQP         192
gi|39545932             DVKA-RPSPY M-PPPSPWTN PR------LD EPERGNSNQQ                     180
CeresClone:1168684      EI KGGRPGPY MQPPPSTWTN QNQNQRAPLD EAERGASNQP                    188
Consensus               D-KAGRPSPY M-PPPSPWTN QR------LD VNVAYVEGRD EPERG-SNQP          200

Lead-CeresClone222894   LTQDFFMMSS GKRKRDEYPG QLPSGSFVPQ QDGSADQI VE FVV---SK          237
gi|39545932             FTQDLFVPSS GKRKRDDSSG HYQNGGSI PQ QDGAGDAI PE ---AN              222
CeresClone:1168684      LTQDFFM-SS GKRKRDEI AS QYNAGGYI PQ QDGAGDAASQ I FEI EVYGGG       237
Consensus               LTQDFFM-SS GKRKRDE--G QY--GG-I PQ QDGAGDAI -E                    250

Lead-CeresClone222894   ENVNQLWSSI GNKLEI PTKT I TPV--I PQR DGL-I QDNYND QFFFP----         279
gi|39545932             FECDAFRI TS I GDRKVPRDF FSSSSKI PQV DGPMPDPYDE MLSTPNI YSY       272
CeresClone:1168684      MSI DAGHSTS KG---KMPAQS DRPASQI PQL DGPI PYD-DD VLSTPNI YNY      284
Consensus               ---DA--STS -G--K-P--- ---P-S-I PQ- DGPI PD-YDD -LSTPNI Y-Y       300
```

Figure 37 (Continued)

```
Lead-CeresClone222894  GVPTEDYNTP GESAEYRAPT PAVGTPKQRN DAGDDNDDD    329
gi|39545932            QGPSEEFNEA RTPAPNEIQT -STPVAVQND -T--E----   314
CeresClone:1168684     GVFNEDYNIA NTPAPSEVPA -STPAPIAQN EV--DEEDD   330

Consensus              GVP-EDYN-A -TPAP-E-PT -STP-P-Q-N ----D---DD  350

Lead-CeresClone222894  DEEI-LDDLEQ GEDEPNTQHL VLAQFDKVSR TKNRWKCTLK  378
gi|39545932            DDDEL-LDDLES GEDM-NTQHL VLAQFDKVTR TKSRWKCSLK 363
CeresClone:1168684     DDDI-LDDLDQ GEDQ-NTHHL VLAQFDKVTR TKSRWKCTLK 378

Consensus              DDD-LDDLEQ GED---NTQHL VLAQFDKVTR TKSRWKCTLK  400

Lead-CeresClone222894  VLFNKATGEF DF          390
gi|39545932            ILFNKAAGEF DF          375
CeresClone:1168684     ILFNKATGEF DF          390

Consensus              ILFNKATGEF DF          412
```

| | |
|---|---|
| Lead-CeresClone222894 | DGI MHLNGRD 378 |
| gi|39545932 | DGI MHI NDKD 363 |
| CeresClone:1168684 | DGI MHI NNKD 378 |
| Consensus | DGI MHI N-KD 400 |

Figure 38

| | | | | | | |
|---|---|---|---|---|---|---|
| gi\|52548134 | MEDGASNEVA | ESSKKIGRGK | EIKRIENTT | NRQVTFCKRR | NGLLKKAYEL | 50 |
| gi\|52548152 | MEGGASNEVA | ESSKKIGRGK | EIKRIENTT | NRQVTFCKRR | NGLLKKAYEL | 50 |
| CeresClone:103400 | MEGGASNEVA | ESSKKIGRGK | EIKRIENTT | NRQVTFCKRR | NGLLKKAYEL | 50 |
| gi\|17223670 | MDEGGSSHDA | ESSKKLGRGK | EIKRIENTT | NRQVTFCKRR | NGLLKKAYEL | 50 |
| Lead-CeresClone22339 | MEEGGSSHDA | ESSKKLGRGK | EIKRIENTT | NRQVTFCKRR | NGLLKKAYEL | 50 |
| gi\|52548104 | MEEGRSSHDG | ESSKKIGRGK | EIKRIENTT | NRQVTFCKRR | NGLLKKAYEL | 35 |
| gi\|14279306 | ----------MGRGK | EIKRIENTT | NRQVTFCKRR | NGLLKKAYEL | 50 | |
| gi\|62132641 | MELPNEGGEG | SSQKKLGRGK | EIKRIENTT | NRQVTFCKRR | NGLLKKAYEL | 50 |
| CeresClone:1046745 | MEDPNQAQEG | SSQKKMGRGK | EIKRIENTT | NRQVTFCKRR | NGLLKKAYEL | 50 |
| CeresClone:1043518 | MEDPNQAQEG | SISQKKMGRGK | EIKRIENTT | NRQVTFCKRR | NGLLKKAYEL | 50 |
| gi\|16973296 | MEFANQAPES | STQKKLGRGK | EIKRIENTT | NRQVTFCKRR | NGLLKKAYEL | 50 |
| gi\|33308109 | MEFPNQAPES | SSQKKLGRGK | EIKRIENTT | NRQVTFCKRR | NGLLKKAYEL | 50 |

Consensus    ME-G-S---EA  ESSKKLGRGK  EIKRIENTT  NRQVTFCKRR  NGLLKKAYEL   50

| | | | | | | |
|---|---|---|---|---|---|---|
| gi\|52548134 | SVLCDAEVAL | VIFSTRGRLY | EYANNSVRGT | ERYKKACSD | AVNPPTITEA | 100 |
| gi\|52548152 | SVLCDAEVAL | VIFSTRGRLY | EYANNSVRGT | ERYKKACSD | AVNPPTITEA | 100 |
| CeresClone:103400 | SVLCDAEVAL | VIFSTRGRLY | EYANNSVRGT | ERYKKACSD | AVNPPTITEA | 100 |
| gi\|17223670 | SVLCDAEVAL | VIFSTRGRLY | EYASNSVKGT | ERYKKACSD | AVNPPTVTEA | 100 |
| Lead-CeresClone22339 | SVLCDAEVAL | VIFSTRGRLY | EYANNSVRGT | ERYKKACSD | AVNPPSVTEA | 100 |
| gi\|52548104 | SVLCDAEVAL | VIFSTRGLLY | EYANNSVRGT | ERYKKACSD | AVNPPXVTEA | 100 |
| gi\|14279306 | SVLCDAEVAL | VFSSTRGRLY | EYANNSVRTT | ERYKKCSD | SSNTGSVSEA | 85 |
| gi\|62132641 | SVLCDAEVAL | VVFSTRGRLY | EYANNSVRAT | XRYKKANAA | STNAESVSEA | 100 |
| CeresClone:1046745 | SVLCDAEVAL | VVFSTRGRLY | EYANNSVRAT | ERYKKANAA | ASNAESVSEA | 100 |
| CeresClone:1043518 | SVLCDAEVAL | IVFSTRGRLY | EYANNSVRAT | DRYKKACAD | STDGGSVSEA | 100 |
| gi\|16973296 | SVLCDAEVAL | LVFSNRGRLY | EYANNSVRAT | DRYKKAYAD | PTNSGSVSEA | 100 |
| gi\|33308109 | SVLCDAEVAL | V-FSTRGRLY | EYANNSVRGT | ERYKKACSD | A-NPPSV-EA | 100 |

Consensus    SVLCDAEVAL  V-FSTRGRLY  EYANNSVRGT  ERYKKACSD   A-NPPSV-EA   100

Figure 38 (Continued)

| | | | | | | |
|---|---|---|---|---|---|---|
| gi\|52548134 | NTQYYQQEAS | KLRRQI RDI Q | NLNRHI LGES | LGSLNFKELK | NLESRLEKGI | 150 |
| gi\|52548152 | NTQYYQQEAS | KLRRQI RDI Q | NLNRHI LGES | LGSLNFKELK | NLESRLEKGI | 150 |
| CeresClone:103400 | NTQYYQQEAS | KLRRQI RDI Q | NLNRHI LGES | LGSLNFKELK | NLESRLEKGI | 150 |
| gi\|17223670 | NTKHYQQEAS | KLRRQI RDI Q | NLNRHI VGES | LGSLNFKELK | NLEGRLEKGI | 150 |
| Lead-CeresClone22339 | NTQYYQQEAS | KLRRQI RDI Q | NSNRHI VGES | LGSLNFKELK | NLEXXLEKGI | 150 |
| gi\|52548104 | NTQYYQQEAS | KLRRQI RDI Q | NSNRHI LGEA | LSSLNFKELK | NLETRLEKGI | 135 |
| gi\|14279306 | NAQFYQQEAS | KLRRQI RDI Q | NLNRHI LGEA | LGSLNFKELK | NLEGRLEKGL | 150 |
| gi\|62132641 | NTQFYQQEAS | XLRRQI RDI Q | NLNRHI LGEA | LGSLSLKELK | NLEGRLEKGL | 150 |
| CeresClone:1046745 | NTQFYQQESS | KLRRQI RDI Q | NLNRHI LGEA | LGSLSLKELK | NLEGRLEKGL | 150 |
| CeresClone:1043518 | NTQFYQQESS | KLRRQI RDI Q | NLNRHI LGEA | LSTLKVKELK | NLEGRLEKGL | 150 |
| gi\|16973296 | NTQFYQQEAS | KLRRQI REI Q | NSNRHI LGES | LSSLNAKELK | NLEGRLEKGL | 150 |
| gi\|33308109 | NTQFYQQEAS | KLRRQI REI Q | NLNRHI LGEA | LSSLNAKELK | NLEGRLEKGL | 150 |

Consensus  NTQFYQQEAS  KLRRQI RDI Q  NLNRHI LGES  LGSLNFKELK  NLEGRLEKGI  150

| | | | | | | |
|---|---|---|---|---|---|---|
| gi\|52548134 | SRVRSKKHEM | LVAEI EYMQK | R---EI ELQND | NMYLRSKI TE | RT GL--QQQE | 196 |
| gi\|52548152 | SRVRSKKHEM | LVAEI EYMQK | R---EI ELQND | NMYLRSKI TE | RT GL--QQQE | 196 |
| CeresClone:103400 | SRVRSKKHEM | LVAEI EYMQK | R---EI ELQND | NMYLRSKI TE | RT GL--QQQE | 198 |
| gi\|17223670 | SRVRSKKSEL | LVAEI EYMQK | RVKEI ELQHV | NMYLRAKI EQ | GARLNPEQHG | 198 |
| Lead-CeresClone22339 | SRVRSKKNEL | LVAEI EYMQK | R---EMELQHN | NMYLRAKI AE | GARLNPDQQE | 198 |
| gi\|52548104 | SRVRSKKNEL | LVAEI EYMQK | R---EMELQHN | NMYLRAKI AE | GARLNPEQQE | 198 |
| gi\|14279306 | SRI RSKKNEL | LFAEI EYMQK | R---EI ELQNS | NLFLRAQI AE | NERA--QQQ- | 180 |
| gi\|62132641 | SRVRSRKHET | LFADI EFMQK | R---EI ELQNH | NNYLRAKI AE | HERA--QQQ- | 195 |
| CeresClone:1046745 | SRVRSRKHET | LFADI EFMQK | R---EI ELQNH | NNYLRAKI AE | NERA--QQR- | 195 |
| CeresClone:1043518 | SRVRSRKHET | LFADVEFMQK | R---EI ETELQHH | NNYLRAKI AE | HERA--QQQ- | 195 |
| gi\|16973296 | SRI RSKKNET | LFSEI EFMQK | R---EI ETELQHH | NNFLRAKI AE | SERE--QQQQ- | 196 |
| gi\|33308109 | SRI RSKKNEM | LFSEI EFMQK | R---EI ELQHH | NNFLRAKI | NERE--EQQ- | 195 |

Consensus  SRVRSKKHE-  L-AEI EYMQK  R---EI ELQN-  NMYLRAKI AE  NERL--QQQE  200

Figure 38 (Continued)

```
gi|52548134        SSVI HQGTVY ESGVT SSHQ SGQYN-RNYI AVNLLEPNQN --SSNQDQPP  242
gi|52548152        SSVI HQGTAY ESGVT SSHQ SGQYN-RNYI AVNLLEPNQN --SSNQDQPP  242
CeresClone:103400  SSVI HQGTVY ESGVT SSHQ SGQYN-RNYI AVNLLEPNQN --SSNQDQPP  244
gi|17223670        SGVI QGTAVY ESGLS SHDQ SQHYN-RNYI PVNLLEPNQQ --FSGQDQPP  245
Lead-CeresClone22339 SSVI QGTTVY ESGVS SHDQ SQHYN-RNYI PVNLLEPNQQ --FSGQDQPP  244
gi|52548104        SSVI QGTTVY ESGVS SHDQ SQHHN-RNYI PVNLLEPNQ- ----------  235
gi|14279306        -MNL MPGSQY ES-VP ---- QQPYDSQNLL PVNLLDPNHH E-YSRHDQTA  221
gi|62132641        QQNL MPETMC ES-LP ---- SQTYD--RNFF PVNLLGSDQQ --YSRQDQTA  237
CeresClone:1046745 QQDMI PGTEC EST P ---N SQSYD--RNFF PVNLI DSNNN Q--YSRQDTA  239
CeresClone:1043518 QSNMMSGTLC ES-LP ---- SQSYD--RNFF PVNLI ASDDQ QQYSSQDHTA  238
gi|16973296        QTHMI PGTSY DPSMP ---- SQNSYD--RNFF PV LESNNNH --YPRQGQTA  238
gi|33308109        HTHMMPGTSY DQSMP ---- SHSYD--RNFL PAVI LESNNN H--YPHQVQTA  238

Consensus          SS-I M-GTVY ESGV---S--Q SQ-Y--RNYI PVNLLEPNQN ---YS-QDQTA  250 gi|52548134        LQLV  246
gi|52548152        LQLV  246
CeresClone:103400  LQLV  248
gi|17223670        LQLV  249
Lead-CeresClone22339 LQLV  248
gi|52548104        ----  235
gi|14279306        LQLV  225
gi|62132641        LQLV  241
CeresClone:1046745 LQLV  243
CeresClone:1043518 LQLV  242
gi|16973296        LQLV  242
gi|33308109        LQLV  242

Consensus          LQLV  254
```

Figure 40

```
gi|34898016        MATVGQPDAM RRITVHYMNP PPIAGAGEAH VDGLDDEVLD YVIGDVLQDQ  50
Lead-CeresClone232985  MATVGQSGAL RRVTVHYANS PTGSIVAEVS FDDLDDELL- FVLADLLPGQ  50
CeresClone:304618  MATVGQSGAL RRVTVHYASS PTRGAVVEVS LDDLDDELLQ FVLADLLPGQ  50
Consensus          MATVGQSGAL RRVTVHYANS PT---V-EVS -DDLDDELL- FVLADLLPGQ  50 gi|34898016        EGLYQSILYG KYGDD----M RGARNTAL-A QSDGLHYYYH GENSSGEAT-  95
Lead-CeresClone232985  EGLHQSILEG TYLNNQENHM RGAAPSAPYG YSRPEEYRAE SSTAAAAATG  99
CeresClone:304618  EGLHQSILEG AHGSNQENYM RGAGSSAP-- ---SQEYHAQ SSTAAAAAAA  95
Consensus          EGLHQSILEG -YG-NQEN-M RGA---SAP- -S----EY-A- SSTAAAAAT-  100 gi|34898016        S--RNSEIDQ QIEYDLVFA RQL-QAMDNL TIETPADEDD DISCVPSPSD  141
Lead-CeresClone232985  S--RNSCMDE QIASDFEYA KQLQQEMEDL SVKD---EDDN DISCVPSPSD  144
CeresClone:304618  SSRRNPGTDD AQIASDFEYA TKLQQEMEGL SVD-----DDGD GLSCVPSPSD  142
Consensus          S--RNSG-D- -QIASDFEYA -QLQQEME-L SV------DDDD DISCVPSPSD  150 gi|34898016        SET------DE PAEGNNEEAA TQDNDDPDN MTYEQRQALV ESVGNENRGL  186
Lead-CeresClone232985  SDDEHEHHDE EEEADRQEDG DGDDG---PDN MTYEQGQALV ESVGTEYRGL  192
CeresClone:304618  SDDGHDHHDE EDEDEEDGNG GGDDDDDPDN MTYEQRQALV ESVGSEDRGL  192
Consensus          SDD-H-HHDE E--E----E-G -GDD-DDPDN MTYEQRQALV ESVG-E-RGL  200 gi|34898016        SDLISYLET WKYK-SGFFP RKANHDNCPI CLSAFRRRET LITLACKHSY  235
Lead-CeresClone232985  SDELISYLQS WKYKSSGLFS RKTNHEDCPI CLSTFRNRET MITLPCRHHY  242
CeresClone:304618  SDELISYLQP WKYKASGFFS RKTNHDDCPI CLSTFRNRET MITLPCMHHY  242
Consensus          SDELISYLQ- WKYK-SGFFS RKTNHDDCPI CLSTFRNRET MITLPC-HHY  250 gi|34898016        HEGCIARWLK IDKACPVCKY EVFGPS  261
Lead-CeresClone232985  HAACVTRWLK VNKTCPVCKY ELFGPS  268
CeresClone:304618  HAACVTKWLR VNKTCPVCKY ELFGPC  268
Consensus          HAACVTRWLK VNKTCPVCKY ELFGPS  276
```

Figure 41 (Continued)

```
gi|15293233         LFYAA PLML  WI FGPVL VFL  CSVVMVPLLY  NLD FFFF GKE  RRK------      229
CeresClone:562000   LFYAGL PLLL WI FGPVL VFL  CSL T MVPVLY NLD F VFT S CK GKV------      223
CeresClone:736573   LFYAGVPLLL  WI FGPLLAFL  S SLVMI PI LY NLDMV N AAD  RGAKEH S SGC    250
gi|50947691         LFYAGVPLLL  WI FGPLLAFL   CSVVMI PI LH SI DVVY VDGS  S K G-EANARV    237
Lead-CeresClone237356 LFYAGVPLLL WI FGPLLAFL  S SMVMVPI LY SLDVV NL MGH SGCVVV S GKS   244

Consensus           LFYAGVPLLL  WI FGPVLAFL  CS-VMVPI LY  NLDVVFV-G-  -K-----S---   250 gi|15293233         ---LDQ K SSF  GSV                                                239
CeresClone:562000   ---DA NE I NR  DFV                                                233
CeresClone:736573   I NGKA N GNGF  MQV                                                263
gi|50947691         EMVYE S D E SV MQV                                                250
Lead-CeresClone237356 AEMNGGSECA  RA V                                                257

Consensus           ------N---S-  --V                                                 263
```

Figure 42

```
Lead-CeresClone25795   MFRSDKAEKM DKRRRRQSKA KASCSEEVSS IEWEAVKMSE EEEDLISRMY   50
CeresClone:1104601     ---------M DRRRRRQSKA KASCSEEVSS IEWEAVKMTE EEEDLISRMY   41

Consensus              MFRSDKAEKM D-RRRRQSKA KASCSEEVSS IEWEAVKM-E EEEDLISRMY   50

Lead-CeresClone25795   KLVGDRWELI AGRIPGRTPE EIERYWLMKH GVVFANRRRD FFRK   94
CeresClone:1104601     KLVGDRWELI AGRIPGRTPE EIERYWLMKH GVVFANRPRD FVRR   85

Consensus              KLVGDRWELI AGRIPGRTPE EIERYWLMKH GVVFANR-RD F-R-   94
```

Figure 43

```
                         50
gi|54287657       MPRLHLLLLA VLAVAAAAE AAAEKPTAY EVLESYDFPV GILPKGVLSY   50
Lead:CeresClone272716  MLAHRLLLLL AVAAASGTAF A-----KPTAY EALADYDFPP GILPKGVVAY   46
CeresClone:678281 MKSAMLPLLL LLAVAGPAA ------KPTAY EALAAFDFPP GILPKGVVSY   45

Consensus         M-----LLLLL -LAVA--AA- A-----KPTAY EALA-YDFPP GILPKGVVSY   50

100
gi|54287657       TLEATGDFT ATLDTGDDDD SSSSTCEFAI EGSYSLRYQR ATGRIATGH   100
Lead:CeresClone272716  TLDNATGAFT ATLDAS-ASG SGSSVCEFSI QGSYSLRYQT KTGKIAPDH   95
CeresClone:678281 TLDNATGDFT AHNS------ --SSTCEFSI QGSYSLRYKP DSGRISVDR   88

Consensus         TLDNATGDFT ATLD------ S-SSTCEFSI QGSYSLRYQ- -ITGRIA-DH  100

150
gi|54287657       LTDLRGVAVK VLFFWLNIVE VTRRGDRLEF SVGIASADFT VDNFLESPQC  150
Lead:CeresClone272716  LTDLEGVSVK VLFFWLNIVE VTRRGDNLEF SVGIVSADFG IENFLECPTC  145
CeresClone:678281 LTNLQGVTVK VLFFWLNIVE VTRSGDQLGF SVGIASADFG LDNFLESPTC  138

Consensus         LTDL-GV-VK VLFFWLNIVE VTRRGD-LEF SVGIASADFG -DNFLESPTC  150 gi|54287657       GCGFDCDDDG SSSSSLPPP LEPSLLRLRG AF                      182
Lead:CeresClone272716  GCGFDCNNLL MLQKPGAA-- --TAKLRLRG AF                      173
CeresClone:678281 GCGFDCNDLL LPQSTAEP-- ---SLRLRG AF                      164

Consensus         GCGFDCNDLL ---QS----P-- ------LRLRG AF                    182
```

Figure 44

| | | | | | | | |
|---|---|---|---|---|---|---|---|
| Lead-CeresClone27793 | MRTGKRNQEE | EDYGEEDFNS | KREGPSSNTT | VHSNRDSKEN | DKASAIRSKH | | 50 |
| CeresClone:522644 | MRAGKGSQEE | DEYEEEEFGS | SKKQGTSSAP | NTNKADGKAI | DKASAIRSKH | | 50 |
| Consensus | MR-GK---QEE | --Y-EE-F-S | -------S--- | ----D-K-- | DKASAIRSKH | | 50 |

| | | | | | | | |
|---|---|---|---|---|---|---|---|
| Lead-CeresClone27793 | SVTEQRRRSK | INERFQILRE | LIPNSEQKRD | TASFLLEVID | YVQYLQEKVQ | | 100 |
| CeresClone:522644 | SVTEQRRRSK | INERFQILRD | LIPHSDQKRD | TASFLLEVIE | YVQYLQEKVQ | | 100 |
| Consensus | SVTEQRRRSK | INERFQILR- | LIP-S-QKRD | TASFLLEVI- | YVQYLQEKVQ | | 100 |

| | | | | | | | |
|---|---|---|---|---|---|---|---|
| Lead-CeresClone27793 | KYEGSYPGWS | QEPTKLTPWR | NNHWRVQSLG | NHPVAINNGS | GPGIPFPGKF | | 150 |
| CeresClone:522644 | KYEGSYQGWG | QEPSKLMPWR | NSHWRVQSFA | GQPTAVKNGL | GPVSPFPGKF | | 150 |
| Consensus | KYEGSY-GW- | QEP-KL-PWR | N-HWRVQS-- | --P-A--NG- | GP---PFPGKF | | 150 |

| | | | | | | | |
|---|---|---|---|---|---|---|---|
| Lead-CeresClone27793 | EDNTVTSTPA | IIAEPQIPIE | SDKARAITGI | SIESQPELDD | KRLPL-PL-- | | 196 |
| CeresClone:522644 | DESNVSISPT | MLNGSQNTID | PDQSRDIVNK | TAERQPDLVS | KGIPLPLAMH | | 200 |
| Consensus | ----V----P- | -------Q-I | -------D--R-I | --E--QP-L-- | K---PLPLAMH | | 200 |

| | | | | | | | |
|---|---|---|---|---|---|---|---|
| Lead-CeresClone27793 | --------- | QPILPM | VQGEQANECP | ATSDGLGQSN | DLVIEGGTIS | | 232 |
| CeresClone:522644 | ANMSVPVRSD | GVLAHPLQGT | VSNAQSTECP | TTSEPQNQQD | ELSVEGGTIS | | 250 |
| Consensus | ANMSVPVRSD | GVLA-P---- | V----Q--ECP | -TS------Q-- | -L---EGGTIS | | 250 |

| | | | | | | | |
|---|---|---|---|---|---|---|---|
| Lead-CeresClone27793 | SSAYSHELL | SSLTQALQNA | GIDLSQAKLS | VQIDLGKRAN | QGLT------ | | 276 |
| CeresClone:522644 | SSAYSQGLL | NNLTQALQSA | GLDLSQASIS | VQINLGKRAN | KGLNCGTSSL | | 300 |
| Consensus | ISSAYS---LL | --LTQALQ-A | G-DLSQA---S | VQI-LGKRAN | -GL-CGTSSL | | 300 |

| | | | | |
|---|---|---|---|---|
| Lead-CeresClone27793 | --HEEPSSKN | PLSYDTQGRD | SSVEEESEHS | HKRMKTL--- | 311 |
| CeresClone:522644 | KHHDNPSSNN | QTI--AHFRD | AGSGEDSDQA | QKRMKTYK | 336 |
| Consensus | KHH--PSS-N | ---YD----RD | ----E-S---- | -KRMKT-K | 338 |

Figure 45

```
CeresClone:40501         MSMSQSRAVQ  RSSS----PNE  DRG--------  -------ENQL  VVYDLKGNDD   34
Lead-CeresClone283597    METSKSPQSS  KNSHIVVPSD   SNGPRFDNDG   FSSEAASNQM   VVFNSEAGDK   50
CeresClone:407007        MESSKSPQSS  KNSRIVVPSD   SNRSRFDNDG   FSSETASNQM   VVFNSEAAD-   49
Consensus                ME-SKSPQSS  KNS-IVVPSD   SNG-RFDNDG   FSSE-ASNQM   VVFNSEA-D-   50

CeresClone:40501         TEEEVLPVQS  Q-PLSSRLQC   PSIGAFTVQC   ASCFKWRLMP   SMQKYEEIRE   83
Lead-CeresClone283597    EQDELGENRL  QKSIITRGIS   PSIGAFTVQC   AKCFKWRLIP   TKEKYEEIRE   100
CeresClone:407007        ---ELGENRL  QKSRIVITKGIS  PSIGAFTVQC   AKCFKWRLIP   TKEKYEEIRE   96
Consensus                ---ELGENRL  QKS-ITRGIS   PSIGAFTVQC   AKCFKWRLIP   TKEKYEEIRE   100

CeresClone:40501         QLLENPFFCD  TAREWKPDIS   CDVPADIYQD   GTRLWAIDKP   NISRPPAGWQ   133
Lead-CeresClone283597    RIIEEPFVCK  RAREWRPDVT   CNDPEDISQD   GSRLWAIDKP   NIAQPPRGWE   150
CeresClone:407007        RIIQEPFVCK  RAREWRPDIT   CNDPEDISQD   GSRLWAIDKP   NIAQPPHGWE   146
Consensus                RII EEPFVCK  RAREWRPDIT   CNDPEDISQD   GSRLWAIDKP   NIAQPP-GWE   150

CeresClone:40501         RLLRIRGEGG  TRFADVYYVA   PSGKKLRSLV   EVQKYLNDNS   EYIGEGVKLS   183
Lead-CeresClone283597    RQIRIRGEGG  TKFADVYYTS   PTGRKLRSLV   EVDRFLQENP   EYGAQGVTLA   200
CeresClone:407007        RQIRIRGEGG  TKFADVYYTS   PTGRKLRSLV   EVDRFLQENP   EHVAQGVTLA   196
Consensus                RQIRIRGEGG  TKFADVYYTS   PTGRKLRSLV   EVDRFLQENP   EY-AQGVTLA   200

CeresClone:40501         QFSFQIPKPL  QDDYVRKRPA   RLLDSIDNTN   TPVAK-----   EANPLAWLSP   228
Lead-CeresClone283597    QFSFQIPRPL  RQDYVKKKKP-  KLINPSDEAS   MASKSFQPE    EVKPIAWAVA   249
CeresClone:407007        QFSFQIPRPL  RQDYVKKKP-   KLINASDEAS   TITSKSSEPE   EVNPIAWAVP   245
Consensus                QFSFQIPRPL  RQDYVKKKP-   KLIN-SDEAS   TI-SKS--PE   EVNPIAWAVP   250

CeresClone:40501         DDH--SLQL   GTPTESGLNN   SHYQPSKKKK   TSTLSIFGSI-  -NDELADRI--  272
Lead-CeresClone283597    TKHEGDASEE  ASLTIDEAPTS  EVMLARKRKA   GSSLSIEPNH   LSDELEPKLE   299
CeresClone:407007        TKHEGDASEE  ASFADETLAS   EVVLTRKRK    GSSLSVEPNH   LSDELEPKLE   295
Consensus                TKHEGDASEE  AS-TDE-L-S   EV-L-RKRK-   GSSLSIEPNH   LSDELEPKLE   300
```

|  | 272 | 301 | 297 |
|---|---|---|---|
| CeresClone:40501 | – | | |
| Lead-CeresClone283597 | | DA | |
| CeresClone:407007 | | DA | |
| Consensus | | DA | 302 |

```
                                                                                          49
Lead-CeresClone286402    MERLQRIFGA -SGMGQPPTD SPLLDSSEQV YISSLALLKM LKHGRAGVPM            50
CeresClone:23276         MERLQRIFGA GGGLGHASPD SPTLDTSEQV YISSLALLKM LKHGRAGVPM            50

Consensus                MERLQRIFGA G-G-G-----D SP-LD-SEQV YISSLALLKM LKHGRAGVPM           50

99
Lead-CeresClone286402    EVMGLMLGEF VDDYTVRVVD VFAMPQSGTG VSVEAVDHVF QTNMLDMLKQ            100
CeresClone:23276         EVMGLMLGEF VDEYTVRVVD VFAMPQSGTG VSVEAVDHVF QTNMLDMLKQ            100

Consensus                EVMGLMLGEF VD-YTVRVVD VFAMPQSGTG VSVEAVDHVF QTNMLDMLKQ            100

149
Lead-CeresClone286402    TGRPEMVVGW YHSHPGFGCW LSGVDINTQQ SFEALNPRAV AVVIDPIQSV            150
CeresClone:23276         TGRPEMVVGW YHSHPGFGCW LSGVDINTQQ SFEALNQRAV AVVVDPIQSV            150

Consensus                TGRPEMVVGW YHSHPGFGCW LSGVDINTQQ SFEALN-RAV AVV-DPIQSV             150

199
Lead-CeresClone286402    KGKVVIDAFR LINPQTMMLG QEPRQTTSNV GHLNKPSIQA LIHGLNRHYY            200
CeresClone:23276         KGKVVIDAFR SINPQTIMLG HEPRQTTSNL GHLNKPSIQA LIHGLNRHYY            200

Consensus                KGKVVIDAFR -INPQT-MLG -EPRQTTSN- GHLNKPSIQA LIHGLNRHYY             200

249
Lead-CeresClone286402    SIAINYRKNE LEEKMLLNLH KKKWTDGLIL KRFDTHSKTN EQTVQEMLNL             250
CeresClone:23276         SIAINYRKNE LEEKMLLNLH KKKWTDGLTL RRFDTHSKTN EQTVQEMLSL             250

Consensus                SIAINYRKNE LEEKMLLNLH KKKWTDGL-L -RFDTHSKTN EQTVQEML-L               250

287
Lead-CeresClone286402    AIKYNKAVQE EDELPPEKLA IANVGRQDAK KHLEEHVL--  MSSNIVQTLG            300
CeresClone:23276         AAKYNKAVQE EDELSPEKLA IVNVGRQDAK KHLEEHVSNL  MSSNIVQTLG            300

Consensus                A-KYNKAVQE EDEL-PEKLA I-NVGRQDAK KHLEEHV-NL  MSSNIVQTLG             300

287
Lead-CeresClone286402    ----------  TMLDTVVF                                              308
CeresClone:23276                     TMLDTVVF                                              308

Consensus                            TMLDTVVF                                              308
```

Figure 47

```
                    1                                                        50
gi|38564733         MAGVAPEGSQ FDARQFDSKM NDLLSADGQD FFTSYDEVYD SFDAMGLQEN    50
gi|19697            MAGSAPEGSQ FDARQFDAKM TELLGTEQEE FFTSYDEVYD SFDAMGLQEN    50
gi|2119938          MAGLAPEGSQ FDARQYDAKM TELLGTEQEE FFTSYDEVYD SFDAMGLQEN    50
gi|485943           MAGLAPEGSQ FDARQYDAKM TELLGTEQEE FFTSYDDVHE SFDAMGLQEN    50
Lead-CeresClone29310 MAGSAPEGTQ FDARQFDQKL NEVLEG-QDE FFTSYDEVHE SFDAMGLQEN   49
CeresClone:3997     MAGSAPEGTQ FDTRQFDQRL NEVLDG-QDE FFTSYDEVHE SFDAMGLQEN    49

Consensus           MAG-APEGSQ FDARQFDAKM -ELLGTEQEE FFTSYDEVYD SFDAMGLQEN    50

51                                                      100
gi|38564733         LLRGI YAYGF EKPSAI QQRG IVPFIKGLDV QQAQSGTGK TATFCSGILQ   100
gi|19697            LLRGI YAYGF EKPSAI QQRG VPFCKGLDV QQAQSGTGK TATFCSGVLQ    100
gi|2119938          LLRGI YAYGF EKPSAI QQRG VPFCKGLDV QQAQSGTGK TATFCSGVLQ    100
gi|485943           LLRGI YAYGF EKPSAI QQRG VPFCKGLDV QQAQSGTGK TATFCSGVLQ    100
Lead-CeresClone29310 LLRGI YAYGF EKPSAI QQRG VPFCKGLDV QQAQSGTGK TATFCSGVLQ   99
CeresClone:3997     LLRGI YAYGF EKPSAI QQRG VPFCKGLDV QQAQSGTGK TATFCSGVLQ    99

Consensus           LLRGI YAYGF EKPSAI QQRG IVPFCKGLDV IQQAQSGTGK TATFCSGVLQ   100

101                                                     150
gi|38564733         QLDYNVVECQ ALVLAPTREL AQQI EKVMRA LGDYLGVKVH ACVGGTSVRE   150
gi|19697            QLDYSLVECQ ALVLAPTREL AQQI EKVMRA LGDYLGVKVH ACVGGTSVRE   150
gi|2119938          QLDYSLVECQ ALVLAPTREL AQQI EKVMRA LGDYLGVKVH ACVGGTSVRE   150
gi|485943           QLDYSLVECQ ALVLAPTREL AQQI EKVMRA LGDYLGVKVH ACVGGTSVRE   150
Lead-CeresClone29310 QLDFSLI QCQ ALVLAPTREL AQQI EKVMRA LGDYLGVKVH ACVGGTSVRE 149
CeresClone:3997     QLDYALL QCQ ALVLAPTREL AQQI EKVMRA LGDYQGVKVH ACVGGTSVRE   149

Consensus           QLDYSLVECQ ALVLAPTREL AQQI EKVMRA LGDYLGVKVH ACVGGTSVRE   150

151                                                     200
gi|38564733         DQRI LSAGVH VVVGTPGRVF DMLRRQSLRS DNI KMFVLDE ADEMLSRGFK   200
gi|19697            DQRI LQSGVH VVVGTPGRVF DMLRRQSLRP DHI KMFVLDE ADEMLSRGFK   200
gi|2119938          DQRI LQSGVH VVVGTPGRVF DMLRRQSLRP DHI KMFVLDE ADEMLSRGFK   200
gi|485943           DQRI LQSGVH VVVGTPGRVF DMLRRQSLRP DHI KMFVLDE ADEMLSRGFK   200
Lead-CeresClone29310 DQRI LQAGVH VVVGTPGRVF DMLKRQSLRA DNI KMFVLDE ADEMLSRGFK 199
CeresClone:3997     DQRI LQAGVH VVVGTPGRVF DMLRRQSLRP DCL KMFVLDE ADEMLSRGFK   199

Consensus           DQRI LQ-GVH VVVGTPGRVF DMLRRQSLRP DHI KMFVLDE ADEMLSRGFK   200
```

Figure 47 (Continued)

```
gi|38564733        DQI YDI FQLL  PSKVQVGVFS  ATMPPEALEI  TRKFMNKPVR  I LVKRDELTL  250
gi|19697           DQI YDI FQLL  PPKI QVGVFS  ATMPPEALEI  TRKFMNKPVR  I LVKRDELTL  250
gi|2119938         DQI YDI FQLL  PPKI QVGVFS  ATMPPEALEI  TRKFMSKPVR  I LVKRDEVTL  250
gi|485943          DQI YDI FQLL  PPKI QVGVFS  ATMPPEALEI  TRKFMSKPVR  I LVKRDDVTL  250
Lead-CeresClone29310  DQI YDI FQLL  PPKI QVGVFS  ATMPPEALEI  TRKFMSKPVR  I LVKRDELTL  249
CeresClone:3997    DQI YDI FQLL  PPKI QVGVFS  ATMPPEALEI  TRKFMSKPVR  I LVKRDELTL  249

Consensus          DQI YDI FQLL  PPKI QVGVFS  ATMPPEALEI  TRKFMSKPVR  I LVKRDELTL  250 gi|38564733        EGI KQFYVNV   EKEEWKLETL  CDLYETLAIT  QSVI FVNTRR  KVDWLTDKMR  300
gi|19697           EGI KQFYVNV   DKEEWKLETL  CDLYETLAIT  QSVI FVNTRR  KVDWLTDKMR  300
gi|2119938         EGI KQFYVNV   DKEEWKLETL  CDLYETLAIT  QSVI FVNTRR  KVDWLTDKMR  300
gi|485943          EGI KQFYVNV   EKEEWKLETL  CDLYETLAIT  QSVI FVNTRR  KVDWLTDKMR  300
Lead-CeresClone29310  EGI KQFYVNV   EKEEWKLETL  CDLYETLAIT  QSVI FVNTRR  KGDWLTDKMR  299
CeresClone:3997    EGI KQFYVNV   EKEDWKLETL  CDLYETLAIT  QSVI FVNTRR  KVDWLTDKMR  299

Consensus          EGI KQFYVNV   -KEEWKLETL  CDLYETLAIT  QSVI FVNTRR  KVDWLTDKMR  300 gi|38564733        SRDHTVSATH    GDMDQNTRDI  I MREFRSGSS  RVLI TTDLLA  RGI DVQQVSL  350
gi|19697           SRDHTVSATH    GDMDQNTRDI  MREFRSGSS   RVLI TTDLLA  RGI DVQQVSL  350
gi|2119938         SRDHTVSATH    GDMDQNTRDI  MREFRSGSS   RVLI TTDLLA  RGI DVQQVSL  350
gi|485943          SRDHTVSATH    GDMDQNTRDI  MREFRSGSS   RVLI TTDLLA  RGI DVQQVSL  350
Lead-CeresClone29310  SRDHTVSATH    GDMDQNTRDI  MREFRSGSS   RVLI TTDLLA  RGI DVQQVSL  350
CeresClone:3997    SRDHTVSATH    GDMDQNTRDI  MREFRSGSS   RVLI TTDLLA  RGI DVQQVSL  349

Consensus          SRDHTVSATH    GDMDQNTRDI  I MREFRSGSS  RVLI TTDLLA  RGI DVQQVSL  350 gi|38564733        VI NYDLPTQP   ENYLHRI GRS  GRFGRKGVAI  NFVTLDDEKM  LGDI QKFYNV  400
gi|19697           VI NYDLPTQP   ENYLHRI GRS  GRFGRKGVAI  NSMTKDDERM  LFDI QKFYNV  400
gi|2119938         VI NYDLPTQP   ENYLHRI GRS  GRFGRKGVAI  NFVTKDDERM  LFDI QKFYNV  400
gi|485943          VI NYDLPTQP   ENYLHRI GRS  GRFGRKGVAI  NFVTKDDERM  LFDI QKFYNV  400
Lead-CeresClone29310  VI NFDLPTQP   ENYLHRI GRS  GRFGRKGVAI  NFVTRDDERM  LFDI QKFYNV  399
CeresClone:3997    VI NFDLPTQP   ENYLHRI GRS  GRFGRKGVAI  NFVTLDDQRM  LFDI QKFYNV  399

Consensus          VI NYDLPTQP   ENYLHRI GRS  GRFGRKGVAI  NFVTKDDERM  LFDI QKFYNV  400
```

Figure 47 (Continued)

| | | | |
|---|---|---|---|
| gi\|38564733 | VVEELPSNVA | DLI | 413 |
| gi\|19697 | VIEELPANVA | DLL | 413 |
| gi\|2119938 | VIEELPANVA | DLL | 413 |
| gi\|485943 | VIEELPANVA | DLL | 413 |
| Lead.CeresClone29310 | VVEELPSNVA | DLL | 412 |
| CeresClone:3997 | VVEELPSNVA | DLL | 412 |
| | | | |
| Consensus | V-EELP-NVA | DLL | 413 |

Figure 48

```
Lead-CeresClone29637   MAAVQQQQAM  QKNTLYVGGL  ADEVNESILH  AAFIPFGDIK  DVKTPLDQAN   50
gi|34896798            ----MNQPV   QKNTLYVGGL  AEEVDEKILH  AAFVPFGEIK  DVKTPLDQAT   45
Consensus              MAAVQ--Q--  QKNTLYVGGL  A-EV-E-ILH  AAF-PFG-IK  DVKTPLDQA-   50

Lead-CeresClone29637   QKHRSFGFVT  FLEREDASAA  MDNMDGAELY  GRVLTVNYAL  PEKIKGGEQG  100
gi|34896798            QKHRSFGFVT  FLEREDAAAA  MDNMDGAELF  GRVLTVNYAF  PERIKGGEQG   95
Consensus              QKHRSFGFVT  FLEREDA-AA  MDNMDGAEL-  GRVLTVNYA-  PE-IKGGEQG  100

Lead-CeresClone29637   WAAHPLWADA  DTWFERQQQE  KEILKMQAEN  KAAMETAEEL  HRKKLAEDRQ  150
gi|34896798            WAAQPIWADA  DTWFERQQQE  EEMQRLQAEQ  RAAMQAAEKL  HREKLAAEKE  145
Consensus              WAA-P-WADA  DTWFERQQQE  -E----QAE-  -AAM--AE-L  HR-KLA----  150

Lead-CeresClone29637   GEMEEDTDTK  DDPMARAEAD  ALSHGDA              177
gi|34896798            GEKEEETDTN  ADPMAAAEAQ  ALKQSS-              171
Consensus              GE-EE-TDT-  -DPMA-AEA-  AL----A              177
```

Figure 49

```
CeresClone:481452        MEGINVCKKS SKLG---KKDD LYHVIHKVPY GDSPYVKAKH AQLVDKDPEA    48
Lead-CeresClone304523    MASSKRRFGA AGGA---DKKD LFHVVHKVPA GDSPYVVAKH LQLVEKQPDV    48
gi|52353366              MASSSKRRGG AGGGGAEKKD LFHVVHKVPA GDSPYVRAKH LQLVDKDPET    50
Consensus                MASS--R-G- AGGG---KKD LFHVVHKVPA GDSPYV-AKH LQLVDKDPE-    50

CeresClone:481452        AIVLFWKAIN AGDKVDSALK DMAVVMKQLD RSEEAIEAIR SFRGLCSKHS    98
Lead-CeresClone304523    AIVWFWKAIN SGDRVDSALK DMAVMVMKQQD RSEEAIEAIR SFRHLCSKQA    98
gi|52353366              AIVWFWKAIN SRDKVDSALK DMAVVMKQQD RAKEAIEAIR SFRHLCSRQA   100
Consensus                AIVWFWKAIN SGDKVDSALK DMAVVMKQQD RSEEAIEAIR SFRHLCSKQA   100

CeresClone:481452        QESLDNVLLD LYKKCGKIEE QIELLKRKLR LIYQGEAFNG RLTRTARSHG   148
Lead-CeresClone304523    QESLDNLLID LYKKCGKVEE QIELLKQKLK SIYLGEAFNG KATKKARSHG   148
gi|52353366              QESLDNLLID LYKKCGKVDE QIDLLKQKLK MIYLGEAFNG KATKTARSHG   150
Consensus                QESLDNLLID LYKKCGKVEE QIELLKQKLK -IYLGEAFNG KATKTARSHG   150

CeresClone:481452        KKFQVSIKQE TARLLGNLGW AYMQKENYMM AEVVFKKAQM VDADANKACN   198
Lead-CeresClone304523    KKFQVSIQQE TSRILGNLGW AYMQQNNFEA AELVYRKAQA EPDANRACN    198
gi|52353366              KKFQVSIQQE TSRILGNLGW AYMQQSNYSA AELVYRKAQS EPDANRACN    200
Consensus                KKFQVSIQQE TSRILGNLGW AYMQQ-NY-A AELVYRKAQ- IEPDANRACN   200

CeresClone:481452        LGLCLMRQCR YEEAYYLEE  VLQGKHQGSD EIKSRKRAEE LEELNA-NL    247
Lead-CeresClone304523    LGLCLIKQGR HEEARQALED VRLRRIYGSE DAKVVARAEQ LLRELNPLQC   248
gi|52353366              LGLCLIKQSR HDEARQVLHD VVLRRISGSE DDKVVARAKQ LLHELEPVTH   250
Consensus                LGLCLIKQ-R HEEARQ-LED V-LRRI-GSE D-KVVARAEQ LL-ELNP---   250

CeresClone:481452        PQPEFMADLD LDDDFVKICLD D-MLDAWNTN SSFRDOLAC             296
Lead-CeresClone304523    VSSPFFQVCLS VHEGIMGEPD LVMNEWTPF  ATFRDQMAC             298
gi|52353366              VTSPNNAGLS VSEEIMERLD L-VLNEWTPF  ATLRDQIAC             299
Consensus                V-SPF-AGLS V-E-IM----D L-VLNEWTPF IATFRDQ-AC            300
```

Figure 50

```
Lead-CeresClone306497    MFPSLIHHAS HGRPDVAVAE DAPRSGCGLG LPGHGGGPSV VLTADPKPRL   50
gi|50944571              MFPGLIHHHR LLDADV---- ---------G GGGGSSAGL  VLTADPKPRL   37
Consensus                MFP-LIHH-- ----DVAVAE DAPRSGCGLG --G-G----- VLTADPKPRL Lead-CeresClone306497    RWTADLHDRF VDAVAQLGGP DKATPKAIMR TMGVKGLTLF HLKSHLQKYR  100
gi|50944571              RWTADLHDRF VDAVAQLGGP DKATPKTIMR TMGVKGLTLF HLKSHLQKYR   87
Consensus                RWTADLHDRF VDAVAQLGGP DKATPK-IMR TMGVKGLTLF HLKSHLQKYR Lead-CeresClone306497    LGRQSGKELT EQSKDASYLM EAQSGTTLSP RGSTPDVKES QEVKEALRAQ  150
gi|50944571              LGKQSGKEMA EQSKDASYIL GAQSGTNLSP TVPTPDLKES QELKEALRAQ  137
Consensus                LG-QSGKE-- EQSKDASY-- -AQSGT-LSP ---TPD-KES QE-KEALRAQ Lead-CeresClone306497    MEVQRRLHEQ VEVQKHMQIR MEANQKYIDT ILDKAFKIVS EQLSGFSISD  200
gi|50944571              MEVQRKLHEQ VEVQRHVQIR MEAYQNYIDT LLEKACNIVS EQLNGFSISD  187
Consensus                MEVQR-LHEQ VEVQ-H-QIR MEA-Q-YIDT -L-KA--IVS EQL-GFSISD Lead-CeresClone306497    QDLPILTSAR AMLSPADHLS SSVFPQLSVS SVSLHNPGPG GGKGLPHVAD  250
gi|50944571              HD-----LTSAG VMLSSSDTLS PSIFHQLSVS SISLHSP--- GGKSSPFAAD  231
Consensus                -DLPILTSA- -MLS--D-LS -S-F-QLSVS S-SLH-PGPG GGK---P--AD Lead-CeresClone306497    SHVFSQRPPE QFKRKSR    267
gi|50944571              ADLFFQKAPE --KRKSY    246
Consensus                ---F-Q--PE QFKRKS-    267
```

Figure 51

```
Lead-CeresClone31894   MSERDRRERE  RDRDR--EPDR  DRRRGRDDRD  RERDRDRERD  RERDRDRGLR   49
CeresClone:470947      MTDR-DRDRD  RDRTR-----   ----DRE---  RERRRDKD-D  RDRDRDRAR-   35
CeresClone:1362529     MTDR-DRDRD  RDRTR-----   ----DRE---  RERRRDKD-D  RDRDRDRAR-   35
CeresClone:425645      MSDR-RRDKE  KPRDR-DI DR  HRDR------  ADRHRDRDRD  RDRDRDRDR-   44
CeresClone:696259      MSDR-RRDRE  RPRERGGYDQ   PRER------  VDRHRDRDRD  RDRHRDRDRG   46

Consensus              MSDR--RRDRE  RDRDR-----DR  -R-R----DRD  RDR-RDRDRD  RDRDRDR-R-   50

Lead-CeresClone31894   NKKSRSRTPD  HHARARHVRS  PERYRSRSRS  IDRDRDRDRQ  RH----HRRRS   96
CeresClone:470947      SKRSRSRSPD  RG--------  RS-HARSPSPS  ----ERSHRRR  HH------RT    69
CeresClone:1362529     SKRSRSRSPD  RG--------  RS-HLRSPSPS  ----ERSHRRR  HH------RT    69
CeresClone:425645      -DRERDHRRE  RE--------  RE-RKRSRSPS  ADRDRSHRRH  SHSH-RGRPS    86
CeresClone:696259      QDKERDRDRD  YR--------  RA-RKRSRSPS  ADRDRARRRH  SHSHPHRS     90

Consensus              SKRSRSRSPD  R--------  -RS  RKRSRSRPS  -DRDRSHRRR  -H------RS   100

Lead-CeresClone31894   PSPDAPSRKR  PRQGSV---DD  EKERNKRVV  TDSVDENAPT  ITKKKDKQPS  144
CeresClone:470947      PSPDPPRKRH  RRDSAE---ED  ---HKETKKAV  SDFVDGIV--  -----KEQQ    107
CeresClone:1362529     PSPDPPRKRH  RRDSTE---EE  ---HKETKKAV  SDFVDGIV--  -----KEQQQK  109
CeresClone:425645      PSPDAGRHKR  RREASPASAD  HHHKEDKKAA  DSHAT-----  ----PGGG     125
CeresClone:696259      RSPDAGRHKR  RREGSP---VA  --DSKEDRKP-  ----------  ----DPPK     120

Consensus              PSPDAPRKKR  RR--SS----ED  --HKE-KKAV  SD-VD-----  -----KQ-K    150

Lead-CeresClone31894   DAADNGGGED  EEGMDVNEIE  MMKMLGI PTG  FDSTKGKPVA  GADVSGIRAV  194
CeresClone:470947      QKENGDGGEG  EAEGSEDELE  IMKMFGI PTG  FDSTKGKPVP  GADVSGVRAV  157
CeresClone:1362529     QQKDNGDGGG  EAEGNEDELE  MMKMFGI PTG  FDSTKGKPVP  GADVSGVRAV  159
CeresClone:425645      DIAAAAAVG   DGDVNAEELE  MMKMMGI PVG  FDSTKGKHVP  DADVSGVRAV  175
CeresClone:696259      AAEEAAAPVG  DGDVDAEELE  MMKMMGI PVG  FDSTKGKYVP  GADVSGVRAV  170

Consensus              ---ED----G-G  E--V----ELE  MMKMMGI PTG  FDSTKGKPVP  GADVSGVRAV  200
```

| | | | |
|---|---|---|---|
| Lead-CeresClone31894 | TKRQPRQYMN | RRGGFNRPLP | AERNR | 219 |
| CeresClone:470947 | TKRQPRQYMN | RRGGFNRPLP | AERNR | 182 |
| CeresClone:1362529 | TKRQPAQYMN | RRGGFNRPFA | AEKNR | 184 |
| CeresClone:425645 | TKRQPRQYMN | RRGGFNRPLP | PERNR | 200 |
| CeresClone:696259 | TKRQPRQYMN | RRGGFNRPLP | PEVNR | 195 |
| Consensus | TKRQPRQYMN | RRGGFNRPLP | AERNR | 225 |

```
                                                                              46
Lead-CeresClone319760    MHRGGDRSGG  PS|--SGGDRS  GA|--RFQRGP  SRWSGSSGGG  LGGSPPNRYS   47
CeresClone:819279        MHRGSDRSGD  PSGPAGGARS   GADGRFARGP   SRW----SGGG GGSPPPHRSS Consensus                MHRG-DRSG-  PSGP-CG-RS   GADGRF-RGP   SRWSGSSGGG  -G--PP-R-S   50

92
Lead-CeresClone319760    SRGAADGGGG  GGGGGRFHPY   RGSSDYSSGG   ---GGYRGGS   GVGNDFGDQ-   97
CeresClone:819279        RGGSSDGGGG  GGGGGRFHPY   RAPSEYVVGG   GGTGGYRCGG   GGGGDFGETA Consensus                ---G--DGGGG GGGGGRFHPY   R--S-Y--GG   GGTGGYRCG-   G-G-DFG---A  100

139
Lead-CeresClone319760    --|RQRYGGG  TRGGGRGDFQ   DHDSRSNYVK   LFVGSVPRTA   TEEDVRPLFE   146
CeresClone:819279        GGARSRYGGG  G|-GGGRGDYS  DHDNKSGYVK   LFVGSVPRTA   NEDDVRPLFE Consensus                GGAR-RYGGG  -RGGGRGD--   DHD---S-YVK  LFVGSVPRTA   -E-DVRPLFE   150

184
Lead-CeresClone319760    EHGDVLEVAL  KDRKTGEQQ    GML CLCFSCI  ITI EYLFCFQ  VSERL        169
CeresClone:819279        DHGDVLEVAL  RDRKTGEQQ    GEP--------  ----------   -----

Consensus                -HGDVLEVAL  I-DRKTGEQQ   G--CLCFSCI   ITI EYLFCFQ  VSERL        195
```

Figure 53

```
Lead-CeresClone325565   ----------   -------MELD   AD--NLSATEL   RLGLPG----T   SSSSRDDWQK   30
gi|50934701             MASSSSLRST   SCLASAAETD    AD--NLC----   RLGPPGSSI-T   TTTITGGADP   46
gi|20269063             ----------   -------MEFE   RDLNLDATEL   RLGLPG----T   ATRQSEKQTP   31
gi|7442240              ----------   -------MGSYE  TELNLRATEL   RLGLPG----S   DEPQEKRPCS   32

Consensus               ----------   -------ME--   ADLNL-ATEL   RLGLPG----T   ----------P   50

Lead-CeresClone325565   KPSPSVGAKR   V-DD------   GTKSEASGTS   TAAGDLDFDH   DTAAPPI-KAQ   73
gi|50934701             AAKRSLGAKR   SLES------   -TDSMASGTG   TSAAGDEHDD   DTAAPA--KAQ   88
gi|20269063             NSNLAKSNKR   SLPDMNEDPA   GSSRENSSTV   SSNEEKSHDQ   ETAPPPI-KAQ   81
gi|7442240              GSMVRSSNKR   SSPELEESRC   -KSNINSDSS   DSTTTSDHNE   DSVQPA--KMQ   80

Consensus               -S--S----KR   SL-D--E---   GTSS---SGTS   TSA---DHD-   DTAAP---KAQ   100

Lead-CeresClone325565   VVGWPPVRAY   RKNTFQAAAA   ----------   KKVEQKQQGG   GLYVKVSMDG   113
gi|50934701             VVGWPPVRAY   RRNTFHQAAA   ----------   EKQKQQQQGG   GLYVKVSMDG   138
gi|20269063             VVGWPPIRSY   RKNCL-----   ----------   QAKKQEAEAA   GLYVKVSMDG   116
gi|7442240              VVGWPPIRSF   RKNSLQ----   AAAATKKGGD   QKKVEQGDGT   GMYLKVSMAG   116

Consensus               VVGWPP-R-Y   RKNT-Q-AAA   ----------   QKKKQQQQGG   GLYVKVSMDG   150

Lead-CeresClone325565   APYLRKVDLR   MYKGYRELRE   ALDALFTNSF   SA--AAAEGGG   DHQHAIAYED   162
gi|50934701             APYLRKVDLK   MCKGYRELRE   ALDLLFTKCF   SA-TASDGCS   DGQFAIAYED   187
gi|20269063             APYLRKIDLK   VYKGYPELLK   ALEEMFKSKV   GEYSEREGYN   GSEHVPTYED   166
gi|7442240              APYLRKIDLK   VYKSYPELLK   ALQNLFKCTF   GEYSEREGYN   GSEYAPTYED   166

Consensus               APYLRK-DLK   -YKGY-EL--   ALD-LF---F   --YS--EGYN   -S--HA--YED   200

Lead-CeresClone325565   KDGDLMLAGD   VPWDMFISSC   KKLRIMKGSA   SEAR------   ----------   196
gi|50934701             KDGDLMLVGD   VPWEMFISSC   KKLRIMKG--   SEAR------   ----------   219
gi|20269063             KDGDWMLVGD   VPWDMFINSC   KRLRIMKE--   SEARGLGCAV   ----------   204
gi|7442240              KDGDWMLVGD   VPWNMFVSSC   KRLRIIKG--   SEAKGLGCL-   ----------   203

Consensus               KDGD-MLVGD   VPWDMFISSC   K-LRIMKG--   SEARGLGC--   ----------   240
```

Figure 55

```
CeresClone:108509      IASVFGNDSD ED-   301
Lead·CeresClone333416  VSSVFGNESD EDS   297
CeresClone:764678      VPSVFGNDSD EEA   306

Consensus              V-SVFGNDSD ED-   313
```

```
CeresClone:553817        LSDQQTDKKE  ANKPPDSWFE  LKINTHVYVT  GLPEDVTTDE  VEVFSKCGI   285
Lead-CeresClone335011    SYENPAEKKE  ANKPPDSWFD  LKVNTHVYVT  GLPDDVTVEE  VEVFSKCCI   256
CeresClone:780844        -SEKPTEKKE  PQKPPESWFD  LKVNTHVYVT  GLPEDVTAEE  VEVFSKCGI   268
gi|50925969              SSEKPADKKE  ANKPPDSWFD  LKVNTHVYVT  GLPDDVTAEE  VEVFSKCGI   257
Consensus                SSEKP--KKE  ANKPPDSWFD  LKVNTHVYVT  GLP-DVTAEE  IVEVFSKCGI  300

CeresClone:553817        KEDPETKKP   RVKLYMDKGT  GRKKGDALVT  YLKEPSVALA  QILDGAPLR   335
Lead-CeresClone335011    IKEDPETKKP  RVKIYTDRET  GRKKGDALVT  YEKEPSVALA  VQLLDGTPFR  306
CeresClone:780844        IKEDPETRKP  RVKIYTDKET  GRKKGDALVT  YLKEPSVPLA  QLLDGTSFR   318
gi|50925969              IKEDPETRKP  RVKIYTDRET  GRKKGDALVT  YLKEPSVALA  QLLDGTSFR   307
Consensus                IKEDPET-KP  RVKIYTD-ET  GRKKGDALVT  YLKEPSVALA  IQLLDGT-FR  350

CeresClone:553817        PNGKLPMSVS  QAKFEQKGDK  FVSKQVDNKK  KKKLKKVEDK  MLGWGRDDA   385
Lead-CeresClone335011    PGGKTHMSVS  PAKFEQKCDV  FVSKKTDKQK  KRKIKKVEDK  MLGWGGHDDK  356
CeresClone:780844        VAKFQQKCDV  FLAKKADKQK  KKKKKVEDK   MLGWGGHDDK  368
gi|50925969              PGGKTLMTVS  PAKFEQKCDV  FISKKTDKQK  KRKTKKVEDK  LLGWGGHDDK  357
Consensus                PGGKTLMSVS  PAKFEQKGDV  FVSKKTDKQK  K-K-KKVEDK  MLGWGGHDDK  400

CeresClone:553817        KVSPATVIL   RYMFAPAEMR  ADENRLELE   EDVKEECIKL  GPLDSVKICE  435
Lead-CeresClone335011    KLMIPATVIL  RHMFTPAELR  ADEELLPELE  ADEEECIKF   GPVDNVKVCE  406
CeresClone:780844        KVMIPTQVIL  ANMFSPAELR  NDETLLPELE  VDVREECVKF  GPIDNVKVCE  418
gi|50925969              KVTITTVIL   RHMFTPAELR  ADETLLPELE  ADVREECMKL  GPVDNVKVCE  407
Consensus                KV-IP-TVIL  RHMFTPAELR  ADETLLPELE  ADVREEC-K-  GPVDNVKVCE  450

CeresClone:553817        NHPQGVVLVR  FKDRKDAQKC  ELMNGRWFG   GRQIHASEDD  GSVNHALVRD  485
Lead-CeresClone335011    NHPQGVILVR  FKDRKDGAKC  EKMNGRWFA   GRQIHASEDD  GSVNHALIRD  456
CeresClone:780844        NHPQGVVLVK  FKDRKDGLKC  EKMNGRWFG   CKQIHASEDD  GSIKHALIRD  468
gi|50925969              NHPEGVILVK  FKDRKDGIKC  EKMNGRWFG   GNQIQASEDD  GSINHALIRD  457
Consensus                NHPQGV-LV-  FKDRKDG-KC  IEKMNGRWFG  GRQIHASEDD  GS-NHALIRD  500
```

```
CeresClone:553817        LEEDAI RLEQ  FGAELEGD-      503
Lead·CeresClone335011    YDAEVSRLDR   FGQELEEST      475
CeresClone:780844        YDAEVSRLER   FGEELEEST      487
gi|50925969              YDAEVSRLDR   FGEELEEST      476

Consensus                YDAEVSRL-R   FGEELEEST      519
```

| | | | | |
|---|---|---|---|---|
| gi\|33589800 | MNGDNRPVED | AHYTETGFPY | AATGSYMDFY | GGAAQGPLNY | DHAATMHPQD | 50 |
| CeresClone:1044196 | ---MSWNPHME | LHYNTISYPY | NTAGSFIEYF | EGLTYEHVNF | IFSGASHAQE | 48 |
| CeresClone:471303 | ---MSWNPHME | VHYNTISYPY | NTAGSFIEYF | EGLTYEHVNF | IFSGASHAQE | 48 |
| Lead-CeresClone335471 | ---MTSSRQME | LHYINTGFPY | TITESFMDFF | EGLTYAHADF | ALMDGFQDQG | 48 |
| CeresClone:226047 | ---MNSSRQME | LHYINTGFPY | TITESFMDFF | EGLTYAHADF | ALTDGFQDQG | 48 |

Consensus   ---MSS-P-ME  LHY---TGFPY  ---TGSFMDFF  EGLTY-HVNF  ---S----H-QD  50

| | | | | |
|---|---|---|---|---|
| gi\|33589800 | NLYWTM-NTN | AYKFGFSGSD | NASFYG---S | YDMNDHLSRM | SIGRTNWDYH | 96 |
| CeresClone:1044196 | SSYPS---NSS | FYKFGLSEPV | NTSYYRYGHG | YEVNHHEPLV | DEYRRPSENS | 96 |
| CeresClone:471303 | SSYPSL--NSS | FYKFGLSEPE | NNSYYRYSHG | YEVNHHEPLV | DEYRRPSENS | 96 |
| Lead-CeresClone335471 | NPYWTMMHTN | SYKYGYSGSC | N---YYSYAHA | YDIDDYMHRT | DGGRRTWDNT | 96 |
| CeresClone:226047 | NPYWAMMHTN | SYKYGYSGPG | N---YYSYADV | YDIDDYMHRA | NGERRIWDNT | 96 |

Consensus   N-YW-M-NTN   SYKFGYSGP-   N-SYY-YAH-   YD-NDHM-RV   D---RR-WDN-  100

| | | | | |
|---|---|---|---|---|
| gi\|33589800 | PMVNVADDPE | NTVARSVQIG | DTDEHSEAEE | CIANEH-DPD | SPQVSWQDDI | 145 |
| CeresClone:1044196 | LTINE-QSA- | AVSTEWVEGG | NTGTRDNSLE | CPRRHHSNSN | DYQVIWQDNI | 144 |
| CeresClone:471303 | LTINE-QSP- | AVSTEWVEGG | NTDTQDNSLE | CRRHHSNSN | DYQVIWQDNI | 144 |
| Lead-CeresClone335471 | TPVNNVDSA- | NVVLQGGEAP | RTTANTTSED | CIQQVHQSPG | SPQVVWQDNI | 145 |
| CeresClone:226047 | TPVNNVDSA- | NVVLQGGEAP | RTTANTINKE | CIQQVHQSPG | SPQVVWQDNI | 145 |

Consensus   ---VN---DSA-   NVV-----VE-G   NT---NT-SEE   CI----H--PN   SPQV-WQDNI  150

| | | | | |
|---|---|---|---|---|
| gi\|33589800 | DPDMTYEEL | VELGEAVGTE | SRGLSQELTE | SIFSRKRAGE | TLPTKKYKFG | 195 |
| CeresClone:1044196 | DPDNMTYEEL | LELGEAVGTQ | SRGLTQEQIS | FFSRKKSRDE | SLPVSKYKCG | 194 |
| CeresClone:471303 | DPDNMTYEEL | LELGEAVGTQ | SRGLTQEQIS | FFLRKKSRDE | SLPVSKYKCG | 194 |
| Lead-CeresClone335471 | DPDNMTYEEL | LDLGEAVGTQ | SRGLSQECTS | FFSRKKTRRE | SLPITKYKCG | 195 |
| CeresClone:226047 | EPDNMTYEEL | LDLGEAVGTQ | SRGLSQERIS | FFSRKKTCRE | SLPVIKYKCG | 195 |

Consensus   DPDNMTYEEL  LELGEAVGTQ  SRGLSQEQIS  FFSRKK-R-E  SLPV-KYKCG  200

Figure 58 (Continued)

```
gi|33589800          RCVI CQLKYK  IGERQMNLPC  KHVYHSECIS   KWLSI NKVCP  VCNSEVFGEP  245
CeresClone:1044196   RCVI CQMEYK  RGDKRI TLPC  KHVYHASCGN  KWLSI NKACP  CYTEVFADK  244
CeresClone:471303    RCVI CQMEYR  RGDKRI TLPC  KHVYHASCGN  KWLSI NKACP  CYTEVFADK  244
Lead-CeresClone335471 RCVI CQMEYR RGNLQI TLPC  KHVYHASCVT  RWLSI NKVCP  VCFAEVPCED 245
CeresClone:226047    RCVI CQMEYR  RGNLQMTLPC  KHVYHASCVT  RWLGI NKVCP  VCFAEVPGED 245

Consensus            RCVI CQMEYR  RG-KQI TLPC  KHVYHASCV-  KWLSI NKVCP  VC--EVFGE-  250 gi|33589800          SLHI----          248
CeresClone:1044196   SKHK----          248
CeresClone:471303    SKHK----          248
Lead-CeresClone335471 SLRQ----         249
CeresClone:226047    PEAMSQQL          253

Consensus            SKHK----          258
```

Figure 59

```
gi|14149141        MQGGD----H  GGMEMGVGSF  TGG-GGGGEC  SSSSATAAAA  AAAAAAAAA   45
Lead-CeresClone336323  MQGGGGDQAG  GSLGMGMGVG  YAG-GGGAEC  SSSSVAAAAA  AAAAAAAE-   46
CeresClone:298091  MQ-RGGDQAG  ASLGMGMGVG  YAGGGGGGEC  SSSS---AAA  AAAAAAAE-   43
CeresClone:528991  MQ-------E  AGLGMGMGMM  S-------GE  ----------  ---------   20
CeresClone:1076901 MQ-------E  AALGM-IGAT  VGG-GGDGD-  ----------  -VSAA----   24
gi|453949          MQ-------E  AALGM-IGAT  VGG-GGDGD-  ----------  -AAVV----   24
gi|8493589         --------- MGAT        V---GGDGD-  ----------  -AAVV----   14
CeresClone:106887  MQ-------E  AALGM-MGAS  V---GGDGD-  ----------  -TAVV----   22
gi|21618231        ---------  -MGAS        ----GGDGD-  ----------  -AAVV----   14

Consensus          MQ--------  AALGM-MGAT  V-G-GGDGD-  ----------  -AAVV----   50 gi|14149141        EAEERQLLKG  EIAVHPLCEQ  LVAAHVGCLR  VATPIDHLPL  DAQLAQSSG   95
Lead-CeresClone336323  AEERQLLKG   EIAVHPLCEQ  LVAAHVGCLR  VATPIDHLPL  DAQLAQSSG   95
CeresClone:298091  -GEERQLLKG  EIAVHPLCEQ  LSAHVSCLR   VATPIDQLPL  DAQLAQSSG   92
CeresClone:528991  -GDHHRQVKA  EIANHPLYEQ  LLAAHVACLR  VATPIDQLPI  DGQLSQSHH   69
CeresClone:1076901 AEQNRQMKG   EIATHPMYDQ  LLAAHVACLR  VATPIDQLPI  EAQLSHSHH   73
gi|453949          AEQNRQMKG   EIATHPMYDQ  LLAAHVACLR  VATPIDQLPI  EAQLSHSHH   73
gi|8493589         AEQNRQLKG   EIATHPMYEQ  LLAAHVACLR  VATPIDQLPI  EAQLSQSHH   63
CeresClone:106887  AEQNRQLKG   EIATHPMYEQ  LLAAHVACLR  VATPIDQLPI  EAQLSQSHH   71
gi|21618231        AEQNRQLKG   EIATHPMYEQ  LLAAHVACLR  VATPIDQLPI  EAQLSQSHH   63

Consensus          -AEQNRQLKG  EIATHPMYEQ  LLAAHVACLR  VATPIDQLPI  DAQLSQSHH  100 gi|14149141        LLHSYAAHHR  PFLSPHDKQE  LDSFLAQYMM  VLCSFREQLQ  QHVRVHAVEA  145
Lead-CeresClone336323  LLHSYAAHHS  PFLSPHDKHD  LDSFLAQYLM  LLCSFREQLQ  QHVRVHAVEA  145
CeresClone:298091  LLHSYAAHHR  PELSPHDKHD  LDSFLAQYLM  LLCTFKEQLQ  QHVRVHAVEA  142
CeresClone:528991  LLHSYASHHS  HSLSPHDRQE  LDNFMAQYLI  VLCSFKEQLQ  QHVRVHAVEA  119
CeresClone:1076901 LLRSYASTAV  GF-SHHDRQE  LDNFLAQYVM  VLCSFKEQLQ  QHVRVHAVEA  122
gi|453949          LLRSYASTAV  GF-SHHDRQE  LDNFLAQYVM  VLCSFKEQLQ  QHVRVHAVEA  122
gi|8493589         LLRSYASTAV  GY--HHDRHE  LDNFLAQYVM  VLCSFKEQLQ  QHVRVHAVEA  111
CeresClone:106887  LLRSYASTAV  GY--HHDRHE  LDNFLAQYVM  VLCSFKEQLQ  QHVRVHAVEA  119
gi|21618231        LLRSYASTAV  GY--HHDRHE  LDNFLAQYVM  VLCSFKEQLQ  QHVRVHAVEA  111

Consensus          LLRSYASTAV  GF-SHHDRHE  LDNFLAQYVM  VLCSFKEQLQ  QHVRVHAVEA  150
```

Figure 59 (Continued)

```
gi|14149141          VMACREI EQS  LQDLTGATLE  EGTGATMSED  EDEIAPMLEG  PMD--MGSD-  192
Lead-CeresClone336323 VMACREI EQS  LQDLTGVTLE  EGTGATMSEE  DEDEAPMLEV  GLVD-MGSD-  193
CeresClone:298091    VMACREI EQS  LQDLTGATLE  EGTGATMSE-  DEDEAPMLEV  GLD--MGSD-  188
CeresClone:528991    VMACRDI ESI  LQALTGVSLG  EGTGATMS-D  DEDEAPMLEV-DG  SLDQSSAD-  165
CeresClone:1076901   VMACREI ENN  LHSLTGATLG  EGSGATMS-E  DEDDLQM--DF  SSDNSGVDFS  170
gi|453949            VMACREI ENN  LHSLTGATLG  EGSGATMS-E  DEDDLQM--DF  SSDNSGVDFS  170
gi|8493589           VMACREI ENN  LHSLTGATLG  EGSGATMS-E  DEDDLPM--DF  SSDNSGVDFS  159
CeresClone:106887    VMACREI ENN  LHSLTGATLG  EGSGATMS-E  DEDDLPM--DF  SSDNSGVDFS  167
gi|21618231          VMACREI ENN  LHSLTGATLG  EGSGATMS-E  DEDDLPM--DF  SSDNSGVDFS  159

Consensus            VMACREI ENN  LHSLTGATLG  EGTGATMS-E  DEDDLPM-DF   SSDNSGVDFS  200 gi|14149141          -GHDLMGFGP   LMPTDSERSL  MERVRQELKI  ELKQGFKSRI  EDVREEILRK  241
Lead-CeresClone336323 -GHDMMGFGP  LLPTDSERSL  MDRVRQELKI  ELKQGFKSRI  EDVREEILRK  242
CeresClone:298091    -GHDMMGFGP   LMPTDSERSL  MERVRQELKM  ELKQGFKSRI  EDVREEILRK  237
CeresClone:528991    -GHDMMGFGP   LLPTESERSL  MERVRQELKI  ELKQGFKSRI  EDVREEILRK  214
CeresClone:1076901   GGHDMTGFGP   LLPTESERSL  MERVRQELKL  ELKQGFKSRI  EDVREEIMRK  220
gi|453949            GGHDMTGFGP   LLPTESERSL  MERVRQELKL  ELKQGFKSRI  EDVREEIMRK  220
gi|8493589           GGHDMTGFGP   LLPTESERSL  MERVRQELKL  ELKQGFKSRI  EDVREEIMRK  209
CeresClone:106887    GGHDMTGFGP   LLPTESEKSL  MERVRQELKL  ELKQGFKSRI  EDVREEIMRK  217
gi|21618231          GGHDMTGFGP   LLPTESEKSL  MERVRQELKL  ELKQGFKSRI  EDVREEIMRK  209

Consensus            GGHDMTGFGP   LLPTESERSL  MERVRQELKL  ELKQGFKSRI  EDVREEIMRK  250 gi|14149141          RRAGKLPGDT  TTILKQWWQQ  HSKWPYPTED  DKAKLVEETG  LQLKQINNWF  291
Lead-CeresClone336323 RRAGKLPGDT TSILKQWWQQ  HSKWPYPTED  DKARLVEETG  LQLKQINNWF  292
CeresClone:298091    RRAGKLPGDT  TSILKQWWQE  HSKWPYPTED  DKAKLVEETG  LQLKQINNWF  287
CeresClone:528991    RRAGKLPGDT  TSVLKAWWQQ  HAKWPYPTED  DKAKLVEETG  LQLKQINNWF  264
CeresClone:1076901   RRAGKLPGDT  TTVLKNWWQQ  HCKWPYPTED  DKAKLVEETG  LQLKQINNWF  270
gi|453949            RRAGKLPGDT  TTVLKNWWQQ  HCKWPYPTED  DKAKLVEETG  LQLKQINNWF  270
gi|8493589           RRAGKLPGDT  TTVLKNWWQQ  HCKWPYPTED  DKAKLVEETG  LQLKQINNWF  259
CeresClone:106887    RRAGKLPGDT  TTVLKNWWQQ  HCKWPYPTED  DKAKLVEETG  LQLKQINNWF  267
gi|21618231          RRAGKLPGDT  TTVLKNWWQQ  HCKWPYPTED  DKAKLVEETG  LQLKQINNWF  259

Consensus            RRAGKLPGDT  TTVLKNWWQQ  HCKWPYPTED  DKAKLVEETG  LQLKQINNWF  300
```

| | | | | |
|---|---|---|---|---|
| gi\|14149141 | NQRKRNWHN | NSQT--STLKS | KRK----- | -R | 314 |
| Lead-CeresClone336323 | NQRKRNWHN | NSQT--STLKS | KRK----- | -R | 315 |
| CeresClone:298091 | NQRKRNWHN | NSQT--STLKS | KRK----- | -R | 310 |
| CeresClone:528991 | NQRKRNWHS | NSQS-SVNLKS | KRKREYA | H | 292 |
| CeresClone:1076901 | NQRKRNWHN | NSHSLTSLKS | KRK----- | H | 294 |
| gi\|453949 | NQRKRNWHN | NSHSLTSLKS | KRK----- | H | 294 |
| gi\|8493589 | NQRKRNWHN | NSHSLTSLKS | KRK----- | H | 283 |
| CeresClone:106887 | NQRKRNWHN | NSHSLTSLKS | KRK----- | H | 291 |
| gi\|21618231 | NQRKRNWHN | NSHSLTSLKS | KRK----- | H | 283 |
| | | | | | |
| Consensus | NQRKRNWHN | NSHSLTSLKS | KRK----- | H | 328 |

```
                                                                              43
gi|31431968          ---MSGRR--- ---ASGRITDD EINELISKLQ SLLPESSRRR GATSRSPATK  42
Lead-CeresClone336524 MSSGGRR--- ----GRISDD  EINELISKLQ ALLPESSRRR NA-SRSSASK  41
CeresClone:280170    ---MSSGRR-- ----GRISDD  EINELISKLQ ALLPESSRRR NA-SRSSASK  46
CeresClone:560681    ---MSSRRSRQ QSASTRISDD  QIIDLVSKLR QLVPEIRDRR S--DKVSASK  47
CeresClone:4734      ---MSNRRSRQ SSSAPRISDN  QMIDLVSKLR QILPEIGQRR RS-DKASASK  47
CeresClone:951040    ---MSNRRSRQ SSSAPRISDD  QIIDLVTKLR QILPEIGQRR RS-DKVSASK Consensus            ---MS-RRSRQ -S--GRISDD  -I---L-SKL- -LLPE-SRRR NA----SSASK  50

88
gi|31431968          LLKEMCSYIKK SLHREVDDLS ERLSELMATM DSNSPQADII RSLLR         87
Lead-CeresClone336524 LLKETCAYVK  SLHREVDDLS ERLSGLMETM DNDSPQAEII RSLLR         86
CeresClone:280170    LLKETCAMIKK SLHREVDDLS ERLSGLMSTM DNDSPQAEII RSLLR         91
CeresClone:560681    VLQETCNYIR  SLHREVDDLS ERLSQLLATI DADSPEAAII RSLIN         92
CeresClone:4734      VLQETCNYIR  NLNREVDNLS ERLSQLLESV DEDSPEAAVI RSLLM         92
CeresClone:951040    VLQETCNYIR  NLNREVDNLS ERLAQLLESV DEDSPQAAVI RSLLM Consensus            -L-ETCNYI-  SLHREVDDLS ERLSQL--TM D DSPQA-II RSLLR            95
```

Figure 61

```
Lead-CeresClone336888   MGDHLALIVD RLLTESTLEA AIGGGKHMVD LRQETVDVEY CH-------- 43
gi|46931308             MGDHFVLLVD RLITESTIEA AIQSRNQML- --QANIPVEE CTILDDKTLE 47
Consensus               MGDH--L--VD RL-TEST-EA AI------M-D LRQ-----VE- C-ILDDKTL-   50

Lead-CeresClone336888   GLGGGSATKV VECRICQEED WDTCMEAPCA CCGSLKYAHR KCIQRWCNEK 93
gi|46931308             MLRNGDLS-M AECRICHDED LDSNMETPCS CSGSVKYAHR RCVQRWCNEK 96
Consensus               -L-----K- -ECRIC---ED -D---ME--PC- C--GS--KYAHR -C--QRWCNEK 100

Lead-CeresClone336888   GDTMCEICLQ QFRPGYTSPQ QLFHYGSIPM NFRGNWEIAR QDLNDSQIIT 143
gi|46931308             GDITCEICHQ EFKPDYTAPP PLLELGHVPL HFRGNWGISQ R------EHRFIT 143
Consensus               GDT-CEIC-Q -F-P-YT-P- -L-----G--P- -FRGNW-I-- -DLN-----IT   150

Lead-CeresClone336888   MMPTERDFMD NYDDYFPIRT RSSTLCCRTI AIIFMSLLVL RHTLPLVIGD 193
gi|46931308             VVPADSTFI- --DQPYPLSS TTSFICCRSL VLIFMALLIL RHTLPLVLTG 190
Consensus               --P-----F-D NYD----P-- --S---CCR-- --IFM-LL--L RHTLPLV---   200

Lead-CeresClone336888   NGEYSLALFS LLVLRTAGIL FPILVMVRAL ASFHHRRRQQ ESQEAYISSS 243
gi|46931308             SNLHVFPLFT LLFLRILGIM LPIYVVTKAV AT----CRRHS RTLDTSPSDD 237
Consensus               ------LF- LL-LR---GI- -PI--V---A- A-FHH--RR-- -------S---   250

Lead-CeresClone336888   ESEEEEEYT VANSAQTNYS QPRFIPVY           271
gi|46931308             SSDEETDSWR LPQ------T QSYIIGVR           259
Consensus               -S-EE----- ---SAQTNY- Q----I -V-                278
```

Figure 62

```
                                                                         50
Lead-CeresClone34060  MADEATRAAF  MEIQASMIEL  TGKLKQVQNQ  MRNKEGDRKR  AFLTLEELRP  50
CeresClone:810464     MADEANRTAF  LEIQSRMIDT  TGKIKQVQTQ  MRSKEAEKKR  AFLTMEELKQ  50

Consensus             MADEA-R-AF  -EIQ---MI--  TGK-KQVQ-Q  MR-KE---KR  AFLT-EEL--

100
Lead-CeresClone34060  LPEETNTYKS  IGRTFVLEPK  TVLEGEQEQK  LKDSEAAVAS  LQTSKEYLEK  100
CeresClone:810464     VPDDTNVYKS  GRMFVLETK   ATLMNEQETK  FKDGEASITA  LQSSKEYLEK  100

Consensus             -P--TN-YKS  IGR-FVLE-K  --L--EQE-K  -KD-EA----  LQ-SKEYLEK Lead-CeresClone34060  QVAEVENNLR  ELLQQEPGIA  QQIMSMSM--  128
CeresClone:810464     QMAEVETNLR  ELLQQDPGLA  RQIMSMNVV   129

Consensus             Q-AEVE-NLR  ELLQQ-PG-A  -QIMSM--V   129
```

Figure 63

```
CeresClone:1604448   MGGRSYSPSP  PRGGRYARRG  RSPSPRGRYG  GGSRGRDLPT  SLLVRNLRLD   50
Lead:CeresClone34406 MRGRSYTPSP  PRG---YGRRG  RSPSPRGRF-  GGSRDSDLPT  SLLVRNLRHD   47
gi|12323160          MRGRSYTPSP  PRG---YGRRG  RSPSPRGRY-  GG-RSRDLPT  SLLVRNLRHD   46

Consensus            MRGRSYTPSP  PRG---YGRRG  RSPSPRGRY-  GGSR-RDLPT  SLLVRNLRHD   50

CeresClone:1604448   CRIPEDVRRPF  GEFGPLKDVY  LPRDYYSGEP  RGFGFVQFVD  PADAAEAKYQ  100
Lead:CeresClone34406 CRQEDLRRPF   EQFGPVKDIY  LPRDYYTGDP  RGFGFIQFMD  PADAAEAKHQ   97
gi|12323160          CRQEDLRKSF   EQFGPVKDIY  LPRDYYTGDP  RGFGFVQFMD  PADAADAKHH   96

Consensus            CRQEDLRRPF   EQFGPVKDIY  LPRDYYTGDP  RGFGFVQFMD  PADAAEAKHQ  100

CeresClone:1604448   MDGQVFQGRE  LTVVFAEENR  KKPSDMRSRE  RRGGGGSRYS  DRRRSPPPRY  150
Lead:CeresClone34406 MDGYLLLGRE  LTVVFAEENR  KKPTEMRTRD  -RGGRSNRFQ  DRRRSPPRYS  146
gi|12323160          MDGYLLLGRE  LTVVFAEENR  KKPTEMRARE  -RGGG---RFR DRRRTPPRY-  143

Consensus            MDGYLLLGRE  LTVVFAEENR  KKPTEMR-RE  -RGGG---RF- DRRRSPPPRY  150

CeresClone:1604448   ----SPPPRH  ARSRSRSRDY  SPPPKRRHQS  RSIXXPRGKRY SRERSYSRSP  196
Lead:CeresClone34406 ----RSPPRRG  RRSRSRSCGY  NSPPAKRHQS  RSVSPQDRRY  EKERSYSRSP  193
gi|12323160          SRSRSPPPRR  GRSRSRSGDY  YSPPPRRHHP  RSISPREERY  DGRRSYSRSP  193

Consensus            ----RSPPPR-  -RSRSRS-DY  -SPP-RRHQS  RS-SPR--RY  ---ERSYSRSP  200

CeresClone:1604448   ----------  ----------  ----------  ----VR---- AHSP------  202
Lead:CeresClone34406 PHNGSRVRSG  SPGRVKSHSR  SPRRSVSPRK  NRSYTPEQAR  SQSPVPRQSR  243
gi|12323160          ASDGSR----  ----------  ----------  ------GR--  SLTPVRGKSR  211

Consensus            ----------  ----------  ----------  ------R---  S-SPV---SR  250

CeresClone:1604448   ----PYNVGV-  ----------                            208
Lead:CeresClone34406 SPTPVPRGAQ   NGDRSPSQ--                            261
gi|12323160          SLTPALEEA-   ----------                            220

Consensus            S-TP---GA-   ----------                            268
```

Figure 64

```
Lead-CeresClone35429    MSLQRPNGNS  SSSSSHKKHK  TAAGSTCVLS  S---------  ----------   31
CeresClone:539578       MSLPRPSEGK  APSQLKEGVA  PAAAEASTSS  SWNNRLNTFP  PLSLHNKNSK   50

Consensus               MSL-RP----  --S-------  -AA-------  S---------  PLSLHNKNSK   50

Lead-CeresClone35429    ---SADDGVN  NPELDQTQNG  VSTA------  ----------  -------KR    54
CeresClone:539578       EDSDEDMFT   VPDVEATPIN  VHSAVTLQNS  NLNQRNVTDP  QFQSGFPGKR   100

Consensus               IEDS--D---  -P------T-  V--AVTLQNS  NLNQRNVTDP  QFQSGFPGKR   100

Lead-CeresClone35429    RRGRNPVDKE  YRSLKRLLRN  RVSAQQARER  KKVYVSDLES  RANELQNNND   104
CeresClone:539578       RRGRNPADKE  HRRLKRLLRN  RVSAQQARER  KKVYVNDLES  RAKEMQDKNA   150

Consensus               RRGRNP-DKE  -R-LKRLLRN  RVSAQQARER  KKVYV-DLES  RA-E-Q---N-  150

Lead-CeresClone35429    QLEEKISTLT  NENTMLRKML  INTRPKTDDN  ----------  H            135
CeresClone:539578       ILEERISTLI  NENTMLRKVL  MNARPKNDDS  IEQKQDQLSK  S            191

Consensus               -LEE-ISTL-  NENTMLRK-L  -N-RPK-DD-  IEQKQDQLSK  -            191
```

Figure 65

| | | | | | | |
|---|---|---|---|---|---|---|
| Lead-CeresClone35786 | MDSTKL SELK | VFIDQCKSDP | SLLITPSLSF | FRDYLESLGA | KIPTGVHEED | 50 |
| CeresClone:288714 | MDASKLRELR | DFVEACKKNP | SLLADPNLSF | FRDYLQSLGA | KIPAAAPSFE | 50 |
| gi\|50904559 | MDASRVGELR | TFVEACKKDP | SLLADPNLAF | FRDYLESLGA | HLPAAAFTKA | 50 |
| Consensus | MDASKL -ELR | -FVEACKKDP | SLLADPNLSF | FRDYLESLGA | KIPAAA---- | 50 |

| | | | | | | |
|---|---|---|---|---|---|---|
| Lead-CeresClone35786 | KDTKPRSFVM | EESDD---DMD | ETEEVK----P | KVEEEEEEDE | IVESDVELEG | 95 |
| CeresClone:288714 | ---SPKRSSM | DDIDD---DD | DDDDLDMRDP | TPERDELDEE | IVESDLELEG | 95 |
| gi\|50904559 | TP-KPKPSSM | DDIDDEYDDI | DDDDLNMRDA | TPEPDELDQD | IVESDLELEG | 99 |
| Consensus | ---KPK-SSM | DDIDD---D-D | DDDDL-MRDP | TPE-DELD-E | IVESDLELEG | 100 |

| | | | | | | |
|---|---|---|---|---|---|---|
| Lead-CeresClone35786 | DIVEPD-NDP | PQKMGDSSVE | VTDENREAAQ | EAKGKAMEAL | SEGNFDEAIE | 144 |
| CeresClone:288714 | EIVQSDHDDP | PQKMGNPSVE | VTEENRDASQ | EAKGKAMEAI | SEGKLEDAIE | 145 |
| gi\|50904559 | DIVESDHQDP | PQKMGDPSID | VTEENRDASQ | EAKSKAMEAM | SEGKLEEAID | 149 |
| Consensus | DIVESDH-DP | PQKMGDPSVE | VTEENRDASQ | EAKGKAMEA- | SEGKLEEAIE | 150 |

| | | | | | | |
|---|---|---|---|---|---|---|
| Lead-CeresClone35786 | HLTRAILNP | TSAIMYGNRA | SVYIKLKKPN | AAIRDANAAL | EINPDSAKGY | 194 |
| CeresClone:288714 | HLTNAIVLNP | LSAIMYGTRA | SVFIKMKKPA | AAIRDANAAL | EINPDSAKGY | 195 |
| gi\|50904559 | HLTKAILLNP | LSAIMYGTRA | SVFIKMKKPV | AAIRDANAAL | EINPDSAKGY | 199 |
| Consensus | HLT-AI-LNP | LSAIMYGTRA | SVFIKMKKP- | AAIRDANAAL | EINPDSAKGY | 200 |

| | | | | | | |
|---|---|---|---|---|---|---|
| Lead-CeresClone35786 | KSRGMARAML | GEWAEAAKDL | HLASTIDYDE | EISAVLKKVE | PNAHKLEEHR | 244 |
| CeresClone:288714 | KTRGMAYAML | GKWEEAAHDL | HTASNMDYDE | EINAVLKKVE | PNAHKIVEHR | 245 |
| gi\|50904559 | KTRGMAYAML | GKWEEAAHDL | HTASNMDYDD | EINAVLKKVE | PNAHKIMEHR | 249 |
| Consensus | KTRGMAYAML | GKWEEAAHDL | HTASNMDYDE | EINAVLKKVE | PNAHKI -EHR | 250 |

| | | | | | | |
|---|---|---|---|---|---|---|
| Lead-CeresClone35786 | RKYDRLRKER | EDKKAERDRL | RRRAEAQAAY | DKAKKEEQS | SSRPSGGGFP | 294 |
| CeresClone:288714 | RKYERLRKER | EEKRAQRDRL | RQRAEAQAAY | DKAKRKEQ-S | SSRSSGGASP | 294 |
| gi\|50904559 | RKYERLRKER | EEKRAERDRF | HRRAEAQAAY | DKAKRKEQ-S | SSRSSGGASP | 298 |
| Consensus | RKYERLRKER | EEKRAERDRL | RRRAEAQAAY | DKAKRKEQ-S | SSRSSGGASP | 300 |

Figure 65 (Continued)

```
Lead·CeresClone35786  GGMPGGFPGG  MPGGFPGGMG  GMPGGFPGGM  GGMGGMPGGF  PGGMGGMPA   344
CeresClone:288714     ----RGFPGG  MPG-------  ----GGFPRGM  ----GGF    PGG-------P 318
gi|50904559           ----RGGFPGG MPG-------  ----GGFPGGM  ----GGF    PGG-------  325

Consensus             ----GGFPGG  MPG-------  ----GGFPGGM  -------GGF PGGM------  350

Lead·CeresClone35786  GMGGGMPGMG  GGMPAGMGGG  GMPGAGGGMP  GGGGMPGGMD  FSKILNDPEL  394
CeresClone:288714     GMPGGFPP--  GGMPGGF---  --P-------  --GGVPGNVD  MSKILNDPDL  352
gi|50904559           --GGGFP---  GGMPGGFPGG  AMP-------  --GGVPGNVD  MSKILNDPDL  361

Consensus             GMGGGFP--G  GGMPGGF-GG  -MP-------  --GGVPGNVD  MSKILNDPDL  400

Lead·CeresClone35786  MTAFSDPEVM  AALQDVMKNP  ANLAKHQANP  KVAPVIAKMM  GKFAGPQ     441
CeresClone:288714     MAAFSDPEVM  AALQDVMNNP  ANFAKHQANP  KVGPIIAKMM  AKFNGSQ     399
gi|50904559           MAAFGDPEVM  AALQDVMNNP  ASFARHQANP  KVGPIIAKMM  AKFNGSQ     408

Consensus             MAAFSDPEVM  AALQDVMNNP  ANFAKHQANP  KVGPIIAKMM  AKFNGSQ     447
```

Figure 66

| | | | | | | |
|---|---|---|---|---|---|---|
| CeresClone:887276 | ------- | ---MAG | A AYEEQRRR | QVEE NQRKLE | ELKLR HLSAA | VREAAT PKPS | 43 |
| Lead-CeresClone362309 | ------- | ------- | ------- | ------- | ------- | ------- | 0 |
| gi\|51091016 | ------- | MI EAESQMA E | AA SYEEQRRR | QVEA NKRKLE | ELRLH HLSAA | VRESA KPSP | 50 |
| Consensus | ------- | ---MA- | A---YEEQRRR | QVE-N-RKLE | EL-L-HLSAA | VRE-A---- | 50 |

| | | | | | | |
|---|---|---|---|---|---|---|
| CeresClone:887276 | PAK S LKRK R V | PRE A GEDAPI | RRSGRVASLP | EQPN Y RF EDV | E HVLE KKI RR | 93 |
| Lead-CeresClone362309 | ------- | -------ME PV | RRSGRLANLP | DKPVYR---EK | VPDF GMKI --- | 30 |
| gi\|51091016 | VK Q RK RKA R A | LPG A GEDAPL | RRSGRVANLP | EKPKYR---DE | F QDFEKRI --- | 96 |
| Consensus | -------R- | ----AGEDAP- | RRSGRVANLP | EKP-YR---D- | F--DFEKKI--- | 100 |

| | | | | | | |
|---|---|---|---|---|---|---|
| CeresClone:887276 | GRRT I T ST RS | DL I NRVYATD | KAREYA I TMA | EELQ AKLGSR | YP S FVKPMTQ | 143 |
| Lead-CeresClone362309 | -RRTYGS V RR | DLTNRVYATD | DAR S YAI SK A | EDLEQEL D SS | FPI FI KPMTQ | 79 |
| gi\|51091016 | RRSYG GKRR | DLSNRVYATD | EQ R DYAI N AA | QELEEELGSD | YPI FVKPM L Q | 145 |
| Consensus | -RRTYGS-RR | DL-NRVYATD | -AR-YAI---A | EELE-ELGS- | YPI FVKPMTQ | 150 |

| | | | | | | |
|---|---|---|---|---|---|---|
| CeresClone:887276 | SHVTGGFWLG | L PLP FCRKHL | PKRDE K LTLK | DE Q G V ESESL | Y LALK N GLSA | 193 |
| Lead-CeresClone362309 | SHVTGGFWLG | L PIHFCRKYL | PKRDEMI TLV | DEDDDESDTL | Y LAMKRGLSA | 129 |
| gi\|51091016 | SHVTGGFWL S | L PTHF SRKYL | PKRDET I RLV | DEEDDEF D TL | Y LA N KRGLS G | 195 |
| Consensus | SHVTGGFWLG | LP-HFCRKYL | PKRDE-I TLV | DE-DDESDTL | YLA-KRGLSA | 200 |

| | | | |
|---|---|---|---|
| CeresClone:887276 | GWRGFAI QHN | V I RQ SYYE R | --- | 233 |
| Lead-CeresClone362309 | GWRGFAVQ QK | T RASSYYES | ED | 171 |
| gi\|51091016 | GWRGFSI A HK | I I RASSYYET | DD | 237 |
| Consensus | GWRGFAI QHK | LI -RTKFKVY | -D | 242 |

Figure 67 (Continued)

```
CeresClone:573215      NKRRTLQKND  IAAAITRTDI  FDFLVDIVPR  EDLKDEVLAS  IPRGTMPVAG   186
CeresClone:474481      NKRRTLQKND  IAAAITRTDI  FDFLVDIVPR  EDLKDEVLAS  IPRGTMPVAG   199
Lead-CeresClone36272   NKRRTLQKND  IAAAVTRTDI  FDFLVDIVPR  EDLRDEVLG-  ---GVGAEAA   164
gi|1922964             NKRRTLQKND  IAAAVTRTDI  FDFLVDIVPR  EDLRDEVLGS  IPRGTVPEAA   155
gi|6289057             NKRRTLQKND  IAAAVTRTDI  FDFLVDIVPR  EDLRDEVLGS  IPRGTVPEAA   178
CeresClone:1911        NKRRTLQKND  IAAAVTRTDI  FDFLVDIVPR  EDLRDEVLGS  IPRGTVPEAA   178
gi|23505813            NKRRTLQKND  IAAAVTRTDI  FDFLVDIVPR  EDLRDEVLGS  IPRGTVPEAA   178

Consensus              NKRRTLQKND  IAAAVTRTDI  FDFLVDIVPR  EDLRDEVLGS  IPRGTVPEAA   200

CeresClone:573215      PADALPYCYM  PPQHASQVGA  AGVIMGKP--  VMDPNMYAQQ  SHPYMAPQMW   234
CeresClone:474481      PADALPYCYM  PPQHPSQVGA  AGVIMGKP-G  VMDPNMYAQQ  SHPYMAPQMW   247
Lead-CeresClone36272   TAAGYPYGYL  PPGTAP--GN  PGMVMGNPGG  AYPPN-----  ----------   205
gi|1922964             -AAGYPYGYL  PAGTAP--GN  PGMVMGNPGG  AYPPN-----  ---PYMGQPMW  196
gi|6289057             -AAGYPYGYL  PAGTAP--GN  PGMVMGNPGG  AYPPN-----  ---PYMGQPMW  219
CeresClone:1911        -AAGYPYGYL  PAGTAP--GN  PGMVMGNPGG  AYPPN-----  ---PYMGQPMW  219
gi|23505813            -AAGYPYGYL  PAGTAP--GN  PGMVMGNPGG  AYPPN-----  ---PYMGQPMW  219

Consensus              -AAGYPYGYL  PAGTAP--GN  PGMVMGNPGG  AYPPN-----  ---PYMGQPMW  250

CeresClone:573215      PQPPDQRQSS  PEH         247
CeresClone:474481      PQPPDQRQSS  PEH         260
Lead-CeresClone36272   QQPGPE-QQD  PDN         217
gi|1922964             QQQAPD-QPD  QEN         208
gi|6289057             QQQAPD-QPD  QEN         231
CeresClone:1911        QQQAPD-QPD  QEN         231
gi|23505813            QQQAPD-QPD  QEN         231

Consensus              QQQAPD-QPD  QEN         263
```

Figure 68

```
Lead-CeresClone36927    MEMES----------FM--D  DLLNFSVPEE  EE-DDDEHTQ  PPRNITRRKT   37
gi|37572445             MKMEALDPSA  ASCFMVDVDD  DLLNFSLEDE  TVFDDDEKIT  --KSITKHKH   48
Consensus               M-ME-LDPSA  ASCFMVDVDD  DLLNFS----E  --FDDDE-T-  PP---T--K-   50

Lead-CeresClone36927    CLRPTDS---  ---FGLF     NTDDLGVVEE  EDLQWISNKN  AFPVIETFVG   78
gi|37572445             PLSSYSSSL   DSSNPVLSLL  PSQQHPECVE  EELEWLSNKD  AFPAVE--FG   96
Consensus               -L------   DSSNPV---L  --------E   E-L-W-SNK-  AFP---ETF-G  100

Lead-CeresClone36927    VLPSEHFPIT  SLLEREATEV  KQLSPVSVLE  TSSHSSTTTT  SNSSGGSNGS  128
gi|37572445             LLA-------  DNPSIVF     DHHSPVSVLE  NSS------ST  CNSSGNGSAN  131
Consensus               -L-SEHFPIT  SLL-------  ---SPVSVLE  -SSHSSTT-T  -NSSG------  150

Lead-CeresClone36927    TAVATTTTTP  TIMSCCVGFK  A-----PAKAR  SKRRRTGRRD  LRVLWTGNEQ  174
gi|37572445             AN--------  AYMSCCASLK  VPVNYPVRAR  SKRRRRRQRG  SFADLPSEHC  173
Consensus               --VATTTTTP  --MSCC---K  -PVNYP---AR  SKRRR----R-  ----------  200

Lead-CeresClone36927    GGIQKKKTMT  V-------   ------AAAALIM  GRKCQHCGAE  KTPQWRAGPA  212
gi|37572445             MSVNKPSFKS  VKQREPLLSL  PLNSAKSASI  GRRCQHCGAD  KTPQWRAGPL  223
Consensus               ----K----  VKQREPLLSL  PLN-A-----  GR-CQHCGA-  KTPQWRAGP-  250

Lead-CeresClone36927    CPKTLCNACG  VRYKSGRLVP  EYRPANSPTF  TAELHSNSHR  KIVEMRKQYQ  262
gi|37572445             CPKTLCNACG  VRYKSGRLLP  EYRPANSPTF  SPTVHSNSHR  KVLEMRKQKI  273
Consensus               GPKTLCNACG  VRYKSGRL-P  EYRPANSPTF  ------HSNSHR  K--EMRKQ--   300

Lead-CeresClone36927    SCDGDGDRKD  CG-----     274
gi|37572445             CVGGMMIHEA  CGYRVG      289
Consensus               ---G------  CGYRVG      316
```

Figure 69

```
Lead-CeresClone374674    MDIEADGRFG  NKRVHNRLGP  ----GSGGAP  PS----TNGK  VCNYWRAGRC    42
CeresClone:1359803       MDLDMNG--G  NKRVFQRL--  ----CGGSNR  PT---TDSNQK VCFHWRAGRC    40
gi|10177733              MDFDLNG--G  NKRVFNRLCG  ----GGGSTR  PMAPTDTRQK  VCFHWRAGRC    44
CeresClone:18612         MDFDLNG--G  NKRVFNRLGG  GGGVGGSTR   PMAPTDTRQK  VCFHWRAGRC    48

Consensus                MD-DLNG--G  NKRVFNRLGG  ----GGGSTR  P-APTDT-QK  VCFHWRAGRC    50

Lead-CeresClone374674    NRFPCPFLHS  ELPEAAPPKR  PTGPGGNVWR  N.NTGRGGG   HHNRWGKGPG    92
CeresClone:1359803       NRYPCPYLHR  ELPG--PGSG  P-VAASNKR   VADESGFAGP  SHRR-CPGFS    86
gi|10177733              NRSPCPYLHR  ELPGPGPGQG  Q-GPGYTNKR  VAEESGFAGP  SHRR-CPGFN    92
CeresClone:18612         NRSPCPYLHR  ELPGPGPGQG  Q-GPGYTNKR  VAEESGFAGP  SHRR-CPGFN    96

Consensus                NR-PCPYLHR  ELPGPGPGQG  --GPGYTNKR  VAEESGFAGP  SHRR-GPGFN   100

Lead-CeresClone374674    GCS-------  -GIASHKPPE  RPCKYFLAGT  ECSYGERCRY  PHSYCISDSI   134
CeresClone:1359803       CTA-NNWGRF  GGNRTVTKTE  KLCKFWVDG-  NCPYGDKCRY  LHCWSKGDSF   134
gi|10177733              GNSSSSWGRF  GGNRTVTKTE  KVCNFWVDG-  NCTYGDKCRY  LHCWSKGESF   141
CeresClone:18612         GNSSSSWGRF  GGNRTVTKTE  KVCNFWVDG-  NCTYGDKCRY  LHCWSKGESF   145

Consensus                GNSSSSWGRF  GGNRTVTKTE  KVC-FWVDG-  NCTYGDKCRY  LHCWSKG--SF  150

Lead-CeresClone374674    AMLTLKGHE   QGVTGIALPA  GSDKLYSGSK  DGTVRMWDCQ  TGQCAGVITM   184
CeresClone:1359803       SLLTQLDGHQ  KVVTGIALPS  GSDKLYTASK  DETVRIWDCA  SGQCTGVLNL   184
gi|10177733              ALLTQLDGHE  KLVSGIALPS  GSDKLYTGSK  DETLRVWDCA  SGQCTGVLKL   191
CeresClone:18612         ALLTQLDGHE  KLVSGIALPS  GSDKLYTGSK  DETLRVWDCA  SGQCTGVLKL   195

Consensus                ALLTQLDGHE  KLV-GIALPS  GSDKLYTGSK  DET-RVWDCA  SGQCTGVLKL   200

Lead-CeresClone374674    GREVGCMILE  GPWLFVGIPD  AVKMWNMQTA  AEMSLTGPIG  QVYALAVASE   234
CeresClone:1359803       GGEVGCIISE  GPWLLVGMPN  LVKAWNIQNN  ADLSLNGPVG  QVYSLVVGTD   234
gi|10177733              GGEICCVLSE  GPWLLVGMPN  LVKAWNIETN  ADQSLSGPVG  QVYSLVVGTD   241
CeresClone:18612         GCEICCVLSE  GPRLLVGMPN  LVKAWNIETN  ADQSLSGPVG  QVYSLVVGTD   245

Consensus                GGE-GCV-SE  GPWLLVGMPN  LVKAWNI-TN  AD-SLSGPVG  QVYSLVVGTD   250
```

Figure 69 (Continued)

|  | | | | | |
|---|---|---|---|---|---|
| Lead-CeresClone374674 | LLFAAT QAGR | LAWRF SAAT | NCFEPAASLD | GHK LAVVSLI | VGGMRLYSAS | 284 |
| CeresClone:1359803 | LLFAGT QDGS | LVWRYNSTT | SCFDPAASLL | GHTLAVVSLY | VGANRLYSGA | 284 |
| gi\|10177733 | LLFAGT QDGS | LAWRYNAAT | NCFEPSASLT | GHTLAVVTLY | VGANRLYSCS | 291 |
| CeresClone:18612 | LLFAGT QDGS | LAWRYNAAT | NCFEPAASLT | GHTLAVVTLY | VGANRLYSGS | 295 |
| Consensus | LLFAGT QDGS | I LAWRYNAAT | NCFEPAASLT | GHTLAVV-LY | VGANRLYSGS | 300 |
| Lead-CeresClone374674 | MDKTI RVWDL | ATLQCI QTLS | DHTDVVMSVL | CWDQFLLSCS | LDQTI KVWAA | 334 |
| CeresClone:1359803 | MDNSI KVWSL | DNLQCI QTLT | EHTSVVMSLI | CWDQFLLSCS | LDNTVKI WAA | 334 |
| gi\|10177733 | MDKTI KVWSL | DNLQCI QTLT | DHSSVVMSLI | CWDQFLLSCS | LDNTVKI WAA | 341 |
| CeresClone:18612 | MDKTI KVWSL | DNLQCI QTLT | DHTSVVMSLI | CWDQFLLSCS | LDNTVKI WAA | 345 |
| Consensus | MDKTI KVWSL | DNLQCI QTLT | DHTSVVMSLI | CWDQFLLSCS | LDNTVKI WAA | 350 |
| Lead-CeresClone374674 | TESGNLEVTY | THKEDQGALA | LSGMPDAQSK | PVLLCSLNDN | TVRLYDLPSF | 384 |
| CeresClone:1359803 | TEGGNLEVTY | THKEEYGVLA | LCGVHDAEAK | PVLLCSCNDN | SLHLYDLPSF | 384 |
| gi\|10177733 | EGGNLEVTY | THKEEHGVLA | LCGVHDAEAK | PVLLCACNDN | TLRLYDLPSF | 391 |
| CeresClone:18612 | IEGGNLEVTY | THKEEHGVLA | LCGVHDAEAK | PVLLCACNDN | TLRLYDLPSF | 395 |
| Consensus | -EGGNLEVTY | THKEEHGVLA | LCGVHDAEAK | PVLLC-CNDN | TLRLYDLPSF | 400 |
| Lead-CeresClone374674 | SDRGRLFSKK | EI RAI QMGPG | GLFFTGDGTG | ELKVWQWDL | AQT---- | 427 |
| CeresClone:1359803 | TERGKIFAKQ | EI RSI QI GPG | GI FFTGDGSG | QVKVWKWSTE | STPILS | 430 |
| gi\|10177733 | TERGKIFAKQ | EI RAI QI GPG | GI FFTGDGTG | QVKVWKWCTE | PTAALP | 437 |
| CeresClone:18612 | TERGKIFAKQ | EI RAI QI GPG | GI FFTGDGTG | QVKVWKWCTE | PTAALP | 441 |
| Consensus | TERGKI FAKQ | EI RAI QI GPG | GI FFTGDGTG | QVKVWKWCTE | -TAALP | 446 |

Figure 70

| | | | | | | |
|---|---|---|---|---|---|---|
| gi\|62546191 | ----MENVSVL | LC---NKEKDQ | MDLPPGFRFH | PTDEELISHY | LYRKVLDTNF | 45 |
| Lead-CeresClone37792 | ---------- | ---------- | MDLPPGFRFH | PTDEELITHY | LHKKVLDLGF | 30 |
| CeresClone:12970 | MFLGEETMET | FCGFQKEEEQ | MDLPPGFRFH | PTDEELITHY | LHKKVLDTSF | 50 |
| Consensus | ----E----- | -C---KE--Q | MDLPPGFRFH | PTDEELITHY | LHKKVLDT-F | 50 |

| | | | | | | |
|---|---|---|---|---|---|---|
| gi\|62546191 | SAKAIGEVDL | NRSEPWDLPW | KAKMGEKEWY | FFCVRDRKYP | TGLRTNRATE | 95 |
| Lead-CeresClone37792 | SAKAIGEVDL | NKAEPWELPY | KAKIGEKEWY | FFCVRDRKYP | TGLRTNRATQ | 80 |
| CeresClone:12970 | SAKAIGEVDL | NKSEPWELPW | MAKMGEKEWY | FFCVRDRKYP | TGLRTNRATE | 100 |
| Consensus | SAKAIGEVDL | NKSEPWELPW | KAKMGEKEWY | FFCVRDRKYP | TGLRTNRATE | 100 |

| | | | | | | |
|---|---|---|---|---|---|---|
| gi\|62546191 | SGYWKATGKD | KEIFRGKSLV | GMKKTLVFYK | GRAPKGEKTD | WVMHEYRLDG | 145 |
| Lead-CeresClone37792 | AGYWKATGKD | KEIFRGKSLV | GMKKTLVFYR | GRAPKGQKTN | WVMHEYRLDG | 130 |
| CeresClone:12970 | AGYWKATGKD | KEIYRGKSLV | GMKKTLVFYR | GRAPKGQKTN | WVMHEYRLEG | 150 |
| Consensus | AGYWKATGKD | KEIFRGKSLV | GMKKTLVFYR | GRAPKGQKTN | WVMHEYRLDG | 150 |

| | | | | | | |
|---|---|---|---|---|---|---|
| gi\|62546191 | KFSFHNLPKT | AKNEWVICRV | FQKSSGVKRT | HISGMMMDS | YGNEMVSSS | 195 |
| Lead-CeresClone37792 | KLSAHNLPKT | AKNEWVICRV | FHKTAGGKKI | PISTLIRIGS | YGTG----- | 175 |
| CeresClone:12970 | LLPSLTDSSP | AKNEWVICRV | FQKSAGGKKI | PISSLIRIGS | LGTD--FNPS | 198 |
| Consensus | KFSAHNLPKT | AKNEWVICRV | FQKSAGGKKI | PIS-LIRIGS | YGT------S | 200 |

| | | | | | | |
|---|---|---|---|---|---|---|
| gi\|62546191 | ALPPLTDSSP | SIGNNTKALS | VTDSAYVPCF | SNPIDVPRG- | IFDSLNNINI | 244 |
| Lead-CeresClone37792 | SLPPLTDSSP | -YNDKTK--- | -TEPVYVPCF | SNQAET-RGT | LNCFSNPSL | 219 |
| CeresClone:12970 | LLPSLTDSSP | -YNDKTK--- | -TEPVYVPCF | SNQTDQNQCT | TLNCFSSPVL | 243 |
| Consensus | -LPPLTDSSP | -YNDKTK--- | -TEPVYVPCF | SNQ-D--RGT | ILNCFSNP-L | 250 |

| | | | | | | |
|---|---|---|---|---|---|---|
| gi\|62546191 | SINSNTLYG | VSSNHSFYNT | QGVQLQAPPT | LPLPSSNHY | LRAFLENQGN | 293 |
| Lead-CeresClone37792 | SSIQPDFLQM | ----PLYQP | QSLNISESI-S | NPVLTQEQSV | LQAMMENNRR | 264 |
| CeresClone:12970 | NSIQADIFHR | ----PLYQT | QSLQVSMNLQ | SPVLTQEHSV | LHAMIENNRR | 289 |
| Consensus | -SIQ-D-L-- | I-----PLYQT | QSLQ-S---- | -PVLTQE-SV | L-AM-ENNRR | 300 |

Figure 71

```
CeresClone:331400      MDSA--SSLVD  ----------G  GGGGAST-DKL  RALAVFAAAS  GTPLERMGSG   46
CeresClone:705041      MDSARSCLVD   ----------   -------STGK  KASPSPAAPA  TKPLQRVGSG   40
gi|50932645            MDST-SCLLD   DASSGA----   -------S     SKALAAAA    SKALQRVGSG   36
CeresClone:597624      MDAI-SCLDE   SITTES-LSIS  QAKPSSI-MS   SEKASPSPPP  PNRLCRVGSG   49
gi|33320073            MEGT-SSLDQ   ESTTSD----   -------SL    SIAPMTTTKP  PESLCRMGSG   37
Lead-CeresClone38311   MDS--SCIDE   -SSSTS----   ----------   -MRLY       RMGSG        9
CeresClone:19561       ------       ----------   ----ESFSATT  AKKLSPPPAA  ALRLYRMGSG   41

Consensus              MDS---SCL-   D--SS----    ----------   S-------A   ----L-RMGSG  50

CeresClone:331400      ASAVVDAAEP   G-----AEADS  GSGAAAVSVG   GKLPSSRYKG  VVPQPNGRWG   92
CeresClone:705041      ASAVMDAPEP   G-----AEADS  G------RV    GRLPSSKYKG  VVPQPNGRWG   79
gi|50932645            ASAVMDAAEP   G-----AEADS  G-GERRGGGG   GKLPSSKYKG  VVPQPNGRWG   81
CeresClone:597624      ASAVVDSDGG   GGGSTEVES    ----------R  KLPSSKYKG   VVPQPNGRWG   89
gi|33320073            TSSVIDGEN    G-----VEAES  ----------R  KLPSSKYKG   VVPQPNGRWG   73
Lead-CeresClone38311   GSSVVLDSEN    G-----VETES ----------R  KLPSSKYKG   VVPQPNGRWG   45
CeresClone:19561       GSSVVLDPEN    G-----LETES ----------   KLPSSKYKG   VVPQPNGRWG   77

Consensus              ASAVVDA-E-   G-------EADS R---------   -KLPSSKYKG  VVPQPNGRWG  100

CeresClone:331400      AQIYERHQRV   WLGTFAGEAD   AARAYDVAAQ   FRPLADA-DP  ---------   141
CeresClone:705041      AQIYERHQRV   WLGTFTGEAE   AARAYDAAAQ   FRSLTES-DP  ---------   128
gi|50932645            AQIYERHQRV   WLGTFTGEAE   AARAYDVAAQ   FRPLAES-DP  ---------   130
CeresClone:597624      SQIYEKHQRV   WLGTFNEEDE   AARAYDVAVQ   FKPLSGT--D  ---------   137
gi|33320073            AQIYEKHQRV   WLGTFNEENE   AARAYDVAAQ   FKPLLENQES  ---------   123
Lead-CeresClone38311   AQIYEKHQRV   WLGTFNEEEE   AASYDIAVR    FKSQVDG---  ---------    92
CeresClone:19561       AQIYEKHQRV   WLGTFNEQEE   AARSYDIAAC   FKNVLE----  ---------   123

Consensus              AQIYEKHQRV   WLGTFNEE-E   AARAYDVAAQ   FKPL-ES-D-  ---------   150
```

Figure 71 (Continued)

```
                                                                                              191
                                                                                              178
                                                                                              180
                                                                                              182
                                                                                              173
                                                                                              132
                                                                                              166
CeresClone:331400       DAAAELRFLA   SRSKAEVVDM   LRKHTYFDEL   AQNKRAFAAA   SAATASSLAN
CeresClone:705041       EDAAELRFLA   ARSKAEVVDM   LRKHTYPDEL   AQYKRAYFAA   AAASSPTSSS
gi|50932645             EAAVELRFLA   SRSKAEVVDM   LRKHTYLEEL   TQNKRAFAAI   SPPPKHPAS
CeresClone:597624       DDDGESEFLN   SHSKSEIVDM   LRKHTYNDEL   EQSKR-----  SRGFVRRRGS
gi|33320073             DDDVEIAFLN   SHSKAEIVDM   LRKHTYIDEL   EQSKKLFGYT   KDGTMAKNKD
Lead-CeresClone:38311   --NDAESAFLD   AHSKAEIVDM   LRKHTYADEF   EQSRRKF---  ----VNGD
CeresClone:19561        --DGDLAFLE   AHSKAEIVDM   LRKHTYADEL   EQNNK-----  RQLFLSVDAN Consensus               DDD-EL-FL-   SHSKAEIVDM   LRKHTY-DEL   EQ-KR-F---   S-----NA-

200

239
                                                                                              224
                                                                                              216
                                                                                              228
                                                                                              223
                                                                                              179
                                                                                              211
CeresClone:331400       NPSSYASLSP   ATATAAA--A   AAREHLFDKT   VTPSDVGKLN   RLVIPKQHAE
CeresClone:705041       VPPAS---SP   SSAASPSP--A   ARREHLFDKT   VTPSDVGKLN   RLVIPKQHAE
gi|50932645             SPTSS-----  ---------S   AAREHLFDKT   VTPSDVGKLN   RLVIPKQHAE
CeresClone:597624       AAGAG----NG   NSISGACV--M   KAREQLFQKA   VTPSDVGKLN   RLVIPKQHAE
gi|33320073             GLIDISSFFG   GGGTIDKVNN   KVREQLFEKA   VTPSDVGKLN   RLVIPKQHAE
Lead-CeresClone:38311   GKRSG---LET   ATYGNDAV--L   RAREVLFEKT   VTPSDVGKLN   RLVIPKQHAE
CeresClone:19561        GKRNG-----S   STITQNDKV--L   KTREVLFEKA   VTPSDVGKLN   RLVIPKQHAE Consensus               ---S------   -T------V--   KARE-LF-KT   VTPSDVGKLN   RLVIPKQHAE

250

274
                                                                                              263
                                                                                              266
                                                                                              268
                                                                                              255
                                                                                              219
                                                                                              245
CeresClone:331400       KHFPLQLPSA   ---------   ---GGESK    GVLLNLEDAA   GKVWRFRYSY
CeresClone:705041       KHFPLQLPSA   G--------   --AAVSGECK   GMLLNFDDSA   GKVWRFRYSY
gi|50932645             KHFPLQLPPP   TTTSSVAAAA   DAAAGGGDCK   GVLLNFEDAA   GKVWKFRYSY
CeresClone:597624       KHFPLQSAAN   GV-------   ---SATAAAAK   GVLLNFEDVG   GKVWRFRYSY
gi|33320073             KHFPLQN---  ---------   ---GNNSK    GVLLNFEDLN   GKVWRFRYSY
Lead-CeresClone:38311   KHFPLSAMT   AM-------   ---GMNPSPTK   GVLINLEDRT   GKVWRFRYSY
CeresClone:19561        KHFPLPSPS-  ---------   ----PAVTK    GVLINFEDVN   GKVWRFRYSY Consensus               KHFPLQSPS-  ---------   -------K    GVLLNFED--   GKVWRFRYSY

```
CeresClone:331400    WNSSQSYVLT  KGWRFVKEK  GLQAGDVVGF  YRSAAGADTK  LFIDCKLRPN  324
CeresClone:705041    WNSSQSYVLT  KGWSRFVKEK  GLHAGDAVGF  YRSI-ASGSNQ  LFIDCKLRSK  312
gi|50932645          WNSSQSYVLT  KGWSRFVKEK  GLHAGDAVGF  YRA-AGKNAQ  LFIDCKVRAK  315
CeresClone:597624    WNSSQSYVLT  KGWSRFVKEK  NLKAGDIVCF  QRS-TGPDRQ  LYIDWKTRNV  317
gi|33320073          WNSSQSYVLT  KGWSRFVKEK  NLKAGDIVSF  QRS-TSGDKQ  LYIDFKARNM  304
Lead-CeresClone38311 WNSSQSYVLT  KGWSRFVKEK  NLRAGDVVCF  ERS-TGPDRQ  LYIHWKVRSI-  267
CeresClone:19561     WNSSQSYVLT  KGWSRFVKEK  NLRAGDVVTF  ERS-TGLERQ  LYIDWKVRSG  294

Consensus            WNSSQSYVLT  KGWSRFVKEK  NL-AGDVV-F  -RS-TG-DRQ  LYIDWKVRS-  350

CeresClone:331400    SVVAAST---  -----AGPSP  RAPVAK----  VRLFGVDLLT  APAT------  357
CeresClone:705041    TTTMTTT---  FVNAAAPSP  -APVMR----  VRLFGVDLLT  APA-------  348
gi|50932645          PTTAAAAAF  LSAVAAAAAP  -PPAVK----  IRLFGVDLLT  AAA-------  354
CeresClone:597624    VNEVALF---  ----------  -GPVVEPIQM  VRLFGVNILK  LPGS------  347
gi|33320073          APTNPVV---  --TNQVQAQV  QVIPRVQ---  MRLFGVNICK  IPATINNVVD  346
Lead-CeresClone38311 ----------  ----------  -SPVQT----  VRLFGVNIFN  V---------  284
CeresClone:19561     PRE-------  ----------  -NPVQV----  VRLFGVDIFN  V---------  314

Consensus            ----------  ----------  --PVVK----  VRLFGVDIL-  VPA-------  400

CeresClone:331400    AAAPAEAVA  VAGCKRARDL  GS----PP   QAAFKKQLVE  LALV       395
CeresClone:705041    PSHVPEHEDC  SMVPKTSKRS  MDANAAATPA  HAVWKKRCID  FALT       392
gi|50932645          PELQDAGGAA  MTKSKRAMDA  MA----ESQA  HVVFKKQCLE  LALT       394
CeresClone:597624    DSIANNNNAS  GCCNGKRR-E  ME--LFSL   -ECSKKP-K  IGAL       384
gi|33320073          NNNNNNNNMA  NCSGGKRMME  ME--LLTF   ESCRIKQRV  IDAL       386
Lead-CeresClone38311 SNEKPNDVAV  ECVGKKRSRE  DD--LFSL   -GCSKKQ-A  INLL       322
CeresClone:19561     TIVKPNDVVA  VCGGKRSRDV  DD--MFAL   -RCSNKQ-A  INAL       352

Consensus            ------PN--A  -C--K--R--  MD----L-S-  -C--KKQ---  I--LL      444
```

Figure 72

| | | | | | |
|---|---|---|---|---|---|
| CeresClone:749427 | MPTGADERVY | CPDCRRATEV | VLDHGTGDTI | CTECALVLDA | HYI DEGFEWR | 50 |
| gi\|18481632 | ----MSDSF | CPDCKKHTEV | AFDHSAGDTV | CTECGLVLEA | HSVDETSEWR | 45 |
| CeresClone:2657 | ----MSDAY | CTDCKKETEL | VVDHSAGDTL | CSECGLVLES | HSI DETSEWR | 45 |
| Lead-CeresClone38950 | ----MSDAF | CSDCKRHTEV | VFDHSAGDTV | CSECGLVLES | HSI DETSEWR | 45 |
| Consensus | ----MSDA- | C-DCK-HTEV | V-DHSAGDTI | C-ECGLVLE- | HSI DETSEWR | 50 |

| | | | | | |
|---|---|---|---|---|---|
| CeresClone:749427 | NFADDGGED | RDPSRVGASG | DPFL-NAKLS | TVIAYDKKPG | KSSGEAGALP | 99 |
| gi\|18481632 | TFANESS--D | NDPVRVGGPT | NPLLTDGGLS | TVI A----- | KPNGAQGEFL | 87 |
| CeresClone:2657 | TFANESS--N | SDPNRVGGPT | NPLLADSALT | TVI A----- | KPNGSSGDFL | 87 |
| Lead-CeresClone38950 | TFANESG--D | NDPVRVGGPT | NPLLADGGLT | TVIS------ | KPNGSSGDFL | 87 |
| Consensus | TFANES----D | NDP-RVGGPT | NPLLAD-GL- | TVI A----- | KPNGSSGDFL | 100 |

| | | | | | |
|---|---|---|---|---|---|
| CeresClone:749427 | RTSVSG-DGA | GAASDKTLVD | GFRGIGDMAD | RLGLVATIRD | HAKETFKKLD | 148 |
| gi\|18481632 | SSSLGRWQNR | GSNPDRSLIL | AFRTIANMAD | RLGLVATIKD | RANEIYKKVE | 137 |
| CeresClone:2657 | SSSLGRWQNR | NSNSDRGLIQ | AFKTIATMSE | RLGLVATIKD | RANELYKRLE | 137 |
| Lead-CeresClone38950 | SSSLGRWQNR | GSNPDRGLIV | AFKTIATMAD | RLGLVATIKD | RANEIYKRVE | 137 |
| Consensus | SSSLGRWQNR | GSN-DR-LI- | AF-TI A-MAD | RLGLVATI KD | RANEIYK---E | 150 |

| | | | | | |
|---|---|---|---|---|---|
| CeresClone:749427 | EAKGVPRGRN | RDSVYAACLY | ACRNLGMPR | TYKELASVTA | AGPAAKKDI G | 198 |
| gi\|18481632 | DLKSL-RGRN | QDAILAACLY | ACRQEDRPR | TVKEI CSV-- | ANGATKKEI G | 184 |
| CeresClone:2657 | DQKSS-RGRN | QDALYAACLY | ACRQEDKPR | TIKEI CVI-- | ANGATKKEI G | 184 |
| Lead-CeresClone38950 | DQKSS-RGRN | QDALLAACLY | ACRQEDKPR | TVKEI CSV-- | ANGATKKEI G | 184 |
| Consensus | DQKS--RGRN | QDAI -AACLY | I ACRQEDKPR | TVKEI CSV-- | ANGATKKEI G | 200 |

| | | | | | |
|---|---|---|---|---|---|
| CeresClone:749427 | KMSTHIKKLL | GEEDGQVMDI | RFCSRLGLCN | QEVRDAQEAV | 248 |
| gi\|18481632 | RAKEFI VKQL | EVEMGQSMEM | RFCSTLGMNN | QAVKAAQEAV | 234 |
| CeresClone:2657 | RAKDYI VKTL | GLEPGQSVDL | RFCSNLAMSN | HAVKAAQEAV | 234 |
| Lead-CeresClone38950 | RAKEYI VKQL | CLETGQVEM | RFCSNLGMTN | QTVKAAQESV | 234 |
| Consensus | RAKEYI VKQL | GLE-GQ---M | RFCSNLGM-N | QAVKAAQEAV | 250 |

Figure 72 (Continued)

```
CeresClone:749427      RR L EE RL DVR  RNPE SI AAAV  YMV VQR AGA  TN PNSA VKDV   298
gi|18481632            QRSEE   LDI R   RSPI SI AAAV  YMI TQLSDD   KKP ---  LKDI  280
CeresClone:2657        QKSEE   FDI R   RSPI SI AA V  YII TQLSDD   KKT ---  LKDI  280
Lead·CeresClone38950   QKSEE   FDI R   RSPI SI AAAV  YII TQLSDE   KKP ---  LRDI  280

Consensus              Q-SEE---DI R    RSPI SI AAAV  IY-ITQLSDD   KKP----LKDI    SVATGVAEGT   300

CeresClone:749427      KE AHKDL TP   HAQM FA----     -----------  --             
gi|18481632            RNSYKDLYP     YASRL PN  Y     AKEEDLKNL C   TP            315
CeresClone:2657        RNSYKDLYP     HLSKI A PSWY    AKEEDLKNL S   SP            312
Lead·CeresClone38950   RNSYKDLYP     HLSKI PAWY      AKEEDLKNL Q   SP            312

Consensus              I RNSYKDLYP   H-SK-I P-WY     AKEEDLKNL -   SP            332
```

SVATGVAEGT
SLATGVAEGT
SH ATGVAEGT
SVATGVAEGT

CeresClone:483433       TFDNVGRWLQ  ELNTHSDTTV  AKMLVGNKCD  LGDIRQVPVE  EGKALAEAEG   149
CeresClone:789317       TFDNVGRWLQ  ELNTHSDTTV  AKMLVGNKCD  LENIREVPVE  EGKALAESEG   149
gi|50947781             TFDNVGRWLQ  ELNTHSDTTV  AKMLVGNKCD  LDNIREVPVE  EGKALAEAEG   149
gi|1370154              TFDSVSRWLD  ELKTHCDTTV  AMMLVGNKCD  LENIRAVSIE  EGKSLAEAQG   149
gi|499068               TFDSVGRWLD  ELKTHCDTTV  AMMLVGNKCD  LENIRAVSID  EGKSLAEAEG   149
gi|2118462              TFDSVGRWLD  ELNTHSDTTV  AMMLVGNKCD  LENIRAVSID  EGKSLAEAEG   149
Lead-CeresClone39279    TFENVGRWLD  ELNTHSDTTV  AKMLIGNKCD  LESIRAVSVE  EGKALAESEG   148
gi|17380746             TFESVGRWLD  QLKTHSDTTV  ARMLVGNKCD  LENIRAVSVE  EGKALAE-EG   148
gi|1076457              TFESVARWLD  ELKTHSDTTV  ARMLVGNKCD  LDNMRAVSVE  EGKALAETQG   148
gi|32815939             TFESVGRWLD  ELKTHSDTTV  ARMLVGNKCD  LESIRAVSVE  EGKALAETEG   148
CeresClone:15416        TFESVGRWLD  ELKTHSDTTV  ARMLVGNKCD  LESIRAVSVE  EGKALAETEG   148

Consensus               TFDSVGRWLD  ELKTHSDTTV  A-MLVGNKCD  LENIRAVSVE  EGKALAE-EG   150

CeresClone:483433       LFFMETSALD  ATNVRTAFEI  VIREIYSNVS  RKVLNSDSYK  AELSL--NRVS  198
CeresClone:789317       LFFMETSALD  STNVRTAFEL  VIKEIYSSVS  RKILNSDTYK  AELSL--NRVS  198
gi|50947781             LFFMETSALD  STNVRTAFEI  VIKEIYSNVS  RKILNSDTYK  AELSL--NRVS  198
gi|1370154              LFFMETSALD  STNVKMAFEM  VIREIYNNVS  RKVLNSDTYK  AELSV--DRVS  198
gi|499068               LFFMETSALD  STNVKMAQEM  VIREIYNNVS  RKVLNSETYK  AELSV--NRVS  198
gi|2118462              LFFMETSALD  STNVKTAFEM  VIREIYSNIS  RKVLNSDSYK  AELSV--NRVS  198
Lead-CeresClone39279    LQFMETSALD  STNVKTAFEM  VILDIYNNVS  RKQLNSDTYK  EELTL--NRVS  197
gi|17380746             LFFVETSALD  STNVKTAFEM  VIRDIYANFS  RKQLNSDTYK  DELTV--NRVS  197
gi|1076457              LFFMETSALN  STNVKTAFEM  VIRDIYTNIS  RKQLNSDMHK  TELKWNSRVS   198
gi|32815939             LFFMETSALD  STNVKTAFEM  VIRDIYTNIS  RKQLNSDTYK  TELSMKNRVS   198
CeresClone:15416        LFFMETSALD  STNVKTAFEM  VIRDIYTNIS  RKQLNSDTYK  TELSMKNRVS   198

Consensus               LFFMETSALD  STNVKTAFEM  VIREIY-NVS  RKVLNSDTYK  AELS---NRVS  200
```

Figure 73 (Continued)

| | | | | | | | | |
|---|---|---|---|---|---|---|---|---|
| CeresClone:483433 | — | DGDS | KDEQ | KQGSRF | GCC | — | — | 216 |
| CeresClone:789317 | — | DDGDS | KDSQ | KQTSRF | GCC | — | — | 217 |
| gi\|50947781 | — | EGDS | KDDQ | KQSNRF | GCC | — | — | 216 |
| gi\|1370154 | L | VNNGAATS | — | KQSKSY | FSCC | — | ST | 219 |
| gi\|499068 | L | VNNGAATS | — | KQNQTY | FSCC | — | SR | 219 |
| gi\|2118462 | L | VNNGAATS | — | KQNQTY | QSCC | — | SR | 219 |
| Lead.CeresClone39279 | L | VKNENE | GT | K—T | FSCCS | — | R— | 214 |
| gi\|17380746 | L | VKDDNSAS | — | KQSSGF | SCCS | — | ST | 218 |
| gi\|1076457 | L | VKDDNKGS | — | KQGSGF | SCCS | — | SS | 219 |
| gi\|32815939 | L | VKDDNKSS | — | TQGFGF | SCCS | — | SS | 219 |
| CeresClone:15416 | L | VKDDNKSS | — | TQGFGF | SCCS | — | SS | 219 |
| Consensus | L | -V-D----S | | KQS--F | -CC- | | S- | 222 |

Figure 74

| | | | | | |
|---|---|---|---|---|---|
| Lead-CeresClone3997 | MAGSAPEGTQ | FD_RQF_DQRL | NEVLD-GQ-D | EFFTSYDEVH | ESFDAMGLQE | 48 |
| CeresClone:30700 | MAGSAPEGTQ | FDARQFDQKL | NEVLE-GQ-D | EFFTSYDDVH | ESFDAMGLQE | 48 |
| gi|19698881 | MAGSAPEGTQ | FDARQFDQKL | NEVLE-GQ-D | EFFTSYDDVH | ESFDAMGLQE | 48 |
| gi|53792733 | MAG_A_PECSQ | FDAK_H_YDSKM | QELLNQGET_E_ | EFFTSYDEVH | ESFDAMGLQE | 50 |
| gi|2119932 | MAGAAPEGSQ | FDARQYDSKM | _T_ELLNA_E_G-Q | EFFTSYDEVY | H_ S_FDAMGLKE | 49 |
| gi|19697 | MAGSAPEGSQ | FDARQFDAKM | _T_ELLGTEQ-E | EFFTSYDEVY | DSFDAMGLQE | 49 |
| gi|2119938 | MAG_L_APEGSQ | FDARQYDAKM | _T_ELLGTEQ-E | EFFTSYDEVY | DSFDAMGLQE | 49 |
| gi|485943 | MAG_L_APEGSQ | FDARQYDAKM | _T_ELL_G_TEQ-E | EFFTSYDEVY | DSFDAMGLQE | 49 |
| Consensus | MAGSAPEGSQ | FDARQ-DAKM | TELL----Q-E | EFFTSYDEV- | ESFDAMGLQE | 50 |
| | | | | | | |
| Lead-CeresClone3997 | NLLRGI YAYG | FEKPSAI QQR | GI VPFCKGLD | VI QQAQSGTG | KTATFCSGVL | 98 |
| CeresClone:30700 | NLLRGI YAYG | FEKPSAI QQR | GI VPFCKGLD | VI QQAQSGTG | KTATFCSGVL | 98 |
| gi|19698881 | NLLRGI YAYG | FEKPSAI QQR | GI VPFCKGLD | VI QQAQSGTG | KTATFCSGVL | 98 |
| gi|53792733 | NLLRGI YAYG | FEKPSAI QQR | GI VPFCKGLD | VI QQAQSGTG | KTATFCSGI L | 100 |
| gi|2119932 | NLLRGI YAYG | FEKPSAI QQR | GI VPFCKGLD | VI QQAQSGTG | KTATFCSGVL | 99 |
| gi|19697 | NLLRGI YAYG | FEKPSAI QQR | GI VPFCKGLD | VI QQAQSGTG | KTATFCSGVL | 99 |
| gi|2119938 | NLLRGI YAYG | FEKPSAI QQR | GI VPFCKGLD | VI QQAQSGTG | KTATFCSGVL | 99 |
| gi|485943 | NLLRGI YAYG | FEKPSAI QQR | GI VPFCKGLD | VI QQAQSGTG | KTATFCSGVL | 99 |
| Consensus | NLLRGI YAYG | FEKPSAI QQR | GI VPFCKGLD | VI QQAQSGTG | KTATFCSGVL | 100 |
| | | | | | | |
| Lead-CeresClone3997 | QQLDYALL_Q_C | QALVLAPTRE | LAQQI EKVMR | ALGDY_Q_GVKV | HACVGGTSVR | 148 |
| CeresClone:30700 | QQLDFSLI QC | QALVLAPTRE | LAQQI EKVMR | ALGDYLGVKV | HACVGGTSVR | 148 |
| gi|19698881 | QQLDFSLI QC | QALVLAPTRE | LAQQI EKVMR | ALGDYLGVKV | HACVGGTSVR | 148 |
| gi|53792733 | QQLDYAVVEC | QALVLAPTRE | LAQQI EKVMR | ALGDYLGVKV | HACVGGTSVR | 150 |
| gi|2119932 | QQLDY_E_LLEC | QALVLAPTRE | LAQQI EKVMR | ALGDYLGVKV | HACVGGTSVR | 149 |
| gi|19697 | QQLDYSLVEC | QALVLAPTRE | LAQQI EKVMR | ALGDYLGVKV | HACVGGTSVR | 149 |
| gi|2119938 | QQLDYSLVEC | QALVLAPTRE | LAQQI EKVMR | ALGDYLGVKV | HACVGGTSVR | 149 |
| gi|485943 | QQLDYSLVEC | QALVLAPTRE | LAQQI EKVMR | ALGDYLGVKV | HACVGGTSVR | 149 |
| Consensus | QQLDYSLI EC | QALVLAPTRE | LAQQI EKVMR | ALGD,LGVKV | HACVGGTSVR | 150 |

Figure 74 (Continued)

| | | | | | | |
|---|---|---|---|---|---|---|
| Lead-CeresClone3997 | EDQRI | LQAGV | HVVVGTPGRV | FDMLRRQSLR | PDCI KMFVLD | EADEMLSRGF | 198 |
| CeresClone:30700 | EDQRI | LQAGV | HVVVGTPGRV | FDMLKRQSLR | ADNI KMFVLD | EADEMLSRGF | 198 |
| gi|19698881 | EDQRI | LQAGV | HVVVGTPGRV | FDMLKRQSLR | ADNI KMFVLD | EADEMLSRGF | 198 |
| gi|53792733 | EDQRI | LASGV | HVVVGTPGRV | FDMLRRQSLR | PDYI KMFVLD | EADEMLSRGF | 200 |
| gi|2119932 | EDQRI | LSSGV | HVVVGTPGRV | FDMLRRQSLR | PDHI KMFVLD | EADEMLSRGF | 199 |
| gi|19697 | EDQRI | LQSGV | HVVVGTPGRV | FDMLRRQSLR | PDHI KMFVLD | EADEMLSRGF | 199 |
| gi|2119938 | EDQRI | LQSGV | HVVVGTPGRV | FDMLRRQSLR | PDHI KMFVLD | EADEMLSRGF | 199 |
| gi|485943 | EDQRI | LQSGV | HVVVGTPGRV | FDMLRRQSLR | PDHI KMFVLD | EADEMLSRGF | 199 |
| Consensus | EDQRI | LQSGV | HVVVGTPGRV | FDMLRRQSLR | PDHI KMFVLD | EADEMLSRGF | 200 |

| | | | | | | |
|---|---|---|---|---|---|---|
| Lead-CeresClone3997 | KDQI | YDI FQL | LPPKI QVGVF | SATMPPEALE | TRKFMSKPV | RI LVKRDELT | 248 |
| CeresClone:30700 | KDQI | YDI FQL | LPPKI QVGVF | SATMPPEALE | TRKFMSKPV | RI LVKRDELT | 248 |
| gi|19698881 | KDQI | YDI FQL | LPPKI QVGVF | SATMPPEALE | TRKFMNKPV | RI LVKRDELT | 248 |
| gi|53792733 | KDQI | YDI FQL | LPSKI QVGVF | SATMPPEALE | TRKFMSKPV | RI LVKRDELT | 250 |
| gi|2119932 | KDQI | YDI FQL | LPPKI QVGVF | SATMPPEALE | TRKFMNKPV | RI LVKRDELT | 249 |
| gi|19697 | KDQI | YDI FQL | LPPKI QVGVF | SATMPPEALE | TRKFMNKPV | RI LVKRDELT | 249 |
| gi|2119938 | KDQI | YDI FQL | LPPKI QVGVF | SATMPPEALE | TRKFMSKPV | RI LVKRDEVT | 249 |
| gi|485943 | KDQI | YDI FQL | LPPKI QVGVF | SATMPPEALE | TRKFMSKPV | RI LVKRDDVT | 249 |
| Consensus | KDQI | YDI FQL | LPPKI QVGVF | SATMPPEALE | TRKFMSKPV | RI LVKRDELT | 250 |

| | | | | | | |
|---|---|---|---|---|---|---|
| Lead-CeresClone3997 | LEGI | KQFYVN | VEKEDWKLET | LCDLYETLAI | TQSVI FVNTR | RKVDWLTDKM | 298 |
| CeresClone:30700 | LEGI | KQFYVN | VEKEEWKLET | LCDLYETLAI | TQSVI FVNTR | RKVDWLTDKM | 298 |
| gi|19698881 | LEGI | KQFYVN | VEKEEWKLET | LCDLYETLAI | TQSVI FVNTR | RKVDWLTDKM | 298 |
| gi|53792733 | VEGI | KQFYVN | VEKEWKLDT | LCDLYETLAI | TQSVI FVNTR | RKVDWLTDKM | 300 |
| gi|2119932 | LEGI | KQFYVN | VDKEEWKLET | LCDLYETLAI | TQSVI FVNTR | RKVDWLTDKM | 299 |
| gi|19697 | LEGI | KQFYVN | VDKEEWKLET | LCDLYETLAI | TQSVI FVNTR | RKVDWLTDKM | 299 |
| gi|2119938 | LEGI | KQFYVN | VDKEEWKLET | LCDLYETLAI | TQSVI FVNTR | RKVDWLTDKM | 299 |
| gi|485943 | LEGI | KQFYVN | VDKEEWKLET | LCDLYETLAI | TQSVI FVNTR | RKVDWLTDKM | 299 |
| Consensus | LEGI | KQFYVN | V-KEEWKLET | LCDLYETLAI | TQSVI FVNTR | RKVDWLTDKM | 300 |

Figure 74 (Continued)

```
Lead-CeresClone3997  RSRDHTVSAT  HGDMDQNTRD  IIMREFRSGS  SRVLITTDLL  ARGIDVQQVS  348
CeresClone:30700     RSRDHTVSAT  HGDMDQNTRD  IIMREFRSGS  SRVLITTDLL  ARGIDVQQVS  348
gi|19698881          RSRDHTVSAT  HGDMDQNTRD  IIMREFRSGS  SRVLITTDLL  ARGIDVQQVS  348
gi|53792733          RGRDHTVSAT  HGDMDQNTRD  IIMREFRSGS  SRVLITTDLL  ARGIDVQQVS  350
gi|2119932           RSRDHTVSAT  HGDMDQNTRD  IIMREFRSGS  SRVLITTDLL  ARGIDVQQVS  349
gi|19697             RSRDHTVSAT  HGDMDQNTRD  IIMREFRSGS  SRVLITTDLL  ARGIDVQQVS  349
gi|2119938           RSRDHTVSAT  HGDMDQNTRD  IIMREFRSGS  SRVLITTDLL  ARGIDVQQVS  349
gi|485943            RSRDHTVSAT  HGDMDQNTRD  IIMREFRSGS  SRVLITTDLL  ARGIDVQQVS  349

Consensus            RSRDHTVSAT  HGDMDQNTRD  IIMREFRSGS  SRVLITTDLL  ARGIDVQQVS  350

Lead-CeresClone3997  LVINFDLPTQ  PENYLHRIGR  SGRFGRKGVA  INFVTLDDQR  MLFDIQKFYN  398
CeresClone:30700     LVINFDLPTQ  PENYLHRIGR  SGRFGRKGVA  INFVTRDDER  MLFDIQKFYN  398
gi|19698881          LVINFDLPTQ  PENYLHRIGR  SGRFGRKGVA  INFVTRDDER  MLFDIQKFYN  398
gi|53792733          LVINYDLPTQ  PENYLHRIGR  SGRFGRKGVA  INFVTRDDER  MLFDIQRFYN  400
gi|2119932           LVINYDLPTQ  PENYLHRIGR  SGRFGRKGVS  NSVTKDDER   MLSDIQRFYN  399
gi|19697             LVINYDLPTQ  PENYLHRIGR  SGRFGRKGVA  INFVTSDDER  MLFDIQKFYN  399
gi|2119938           LVINYDLPTQ  PENYLHRIGR  SGRFGRKGVA  INFVTKDDER  MLFDIQKFYN  399
gi|485943            LVINYDLPTQ  PENYLHRIGR  SGRFGRKGVA  INFVTKDDER  MLFDIQKFYN  399

Consensus            LVINYDLPTQ  PENYLHRIGR  SGRFGRKGVA  INFVT-DDER  MLFDIQKFYN  400

Lead-CeresClone3997  VVVEELPSNV  ADLL  412
CeresClone:30700     VVVEELPSNV  ADLL  412
gi|19698881          VVVEELPSNV  ADLL  412
gi|53792733          VVIEELPANV  ADLL  414
gi|2119932           VVIEELPANV  ADLL  413
gi|19697             VVIEELPANV  ADLL  413
gi|2119938           VVIEELPANV  ADLL  413
gi|485943            VVIEELPANV  ADLL  413

Consensus            VVIEELPANV  ADLL  414
```

Figure 75

```
CeresClone:207629      MASKALI LLG  LFSVLLVVSE  VSAARQSGMV  KPESEETVQP  EGYGGGHGGH  50
gi|20197615            MASKALI LLG  LFSVLLVVSE  VSAARQSGMV  KPESEETVQP  EGYGGGHGGH  50
CeresClone:105261      MASKALI LLG  LFSVLLVVSE  VSSARQSGMV  KPESEETVQP  EGYGGGHGGH  50
gi|21536606            MASKALI LLG  LFSVLLVVSE  VSSARQSGMV  KPESEETVQP  EGYGGGHGGH  50
CeresClone:20104       MASKALI LLG  LFAI LLVVSE  VSAARHAGMV  KPESEETVQP  EGYHGGHGGH  50
Lead-CeresClone39985   MASKALI LLG  LFAI LLVVSE  VSAARQSGMV  KPESEETVQP  EGYHGGHGGH  50

Consensus              MASKALI LLG  LFSVLLVVSE  VSAARQSGMV  KPESEETVQP  EGYGGGHGGH  50

CeresClone:207629      GGHG----GGGG  HGHGGHNGGG  GHGLDGYG--  ----------  ----GHYGG   81
gi|20197615            GGHG----GGGG  HGHGGHNGGG  GHGLDGYGGG  GCHYGGGGGH  YGGGGGHYGG  98
CeresClone:105261      GGHG----GGGG  HGHGGHNGGG  GHGLDGYGGG  GGHYGGGGGH  YCGGGGHYGG  98
gi|21536606            GGHG----GGGG  HGHGGHNGGG  GHGLDGYGGG  GGHYGGGGGH  YGGGGGHYGG  98
CeresClone:20104       GGGHYGGGG    HGHGGHNGGG  GHGLDGYG--  ----------  ----------  78
Lead-CeresClone39985   GGGHYGGGG    HGHGGHNGGG  GHGLDGYG--  ----------  ----------  78

Consensus              GGHG---GGGG  HGHGGHNGGG  GHGLDGYGGG  GGHYGGGGGH  YGGGGGHYGG  100

CeresClone:207629      GGGGYGGGGG   HH--GGGGHGL  NEPVQTKPGV              110
gi|20197615            GGGGYGGGGG   HH--GGGGHGL  NEPVQTKPGV              127
CeresClone:105261      GGGGYGGGGG   HH--GGGGHGL  NEPVQTKPGV              127
gi|21536606            GGGGYGGGGG   HH--GGGGHGL  NEPVQTKPGV              127
CeresClone:20104       ----CGHGG    HH--GGGGHGL  NEPVQTKPGV              102
Lead-CeresClone39985   ----GGHGG    HYGGGGGHGL  NEPVQTKPGV              103

Consensus              GGGGYGGGGG   HH--GGGGHGL  NEPVQTKPGV              130
```

Figure 76

| | | | | | |
|---|---|---|---|---|---|
| Lead-CeresClone40736 | MYPSLDDDFV | SDLFCFDQS- | -NGAELDDYT | QFGVNLQTDQ | EDTFPDFVSY | 48 |
| gi\|20127109 | ------MD | VNLFGHDDSC | SNGAELDDYT | QFGVNLQTDQ | EDTFPDFVSY | 42 |
| CeresClone:590996 | ---------- | ---------- | ---------- | ----MDSLE | DSGCWDFLDY | 15 |
| CeresClone:631135 | ---------- | ---------- | ---------- | ----MDSLE | DSGYWDFLDY | 15 |
| Consensus | ---------- | --LF--D-S- | -NGAELDDYT | QFGVN----- | ---F-DF---Y | 50 |

| Lead-CeresClone40736 | GVNLQQEPDE | VFSIGASQLD | LSSYNGVLSL | EPEQVGQQDC | EVVQEEEVEI | 98 |
| gi\|20127109 | GVNLQQEPDE | VFSIGASQLD | LSSYNGVLSL | EPEQVGQQDC | EVVQEEEVEI | 92 |
| CeresClone:590996 | SFIDQAPPDF | LWSNNNNSVS | ---------- | ---------- | ------TEI | 38 |
| CeresClone:631135 | SFIDQAPPDF | LWSNNTISVN | ---------- | ---------- | ------TEV | 38 |
| Consensus | ----Q---PD- | --S--AS--D | LSSYNGVLSL | EPEQVGQQDC | EVVQEEE-EI | 100 |

| Lead-CeresClone40736 | NSGSSGGAVK | EEQEHLDDDC | SRKRARTGSC | SRGGGTKACR | ERLRREKLNE | 148 |
| gi\|20127109 | NSGSSGGAVK | EEQEHLDDDC | SRKRARTGSC | SRGGGTKACR | ERLRREKLNE | 142 |
| CeresClone:590996 | DIPGDAVACQ | EN-------- | TKKRGRTDSC | FK-AGSKACR | EKLRRERLNE | 79 |
| CeresClone:631135 | DIPGDAAACQ | EN-------- | TKKRGHADSS | CQ-VGSKACR | EKLRRERLNE | 79 |
| Consensus | ----GA---- | E-QEHLDDDC | --KR-RT-SC | SRGGG-KACR | E-LRRE-LNE | 150 |

| Lead-CeresClone40736 | RFMDLSSVLE | PGRTPKTDKP | AILDDAIRIL | NQLRDEALKL | EETNQKLLEE | 198 |
| gi\|20127109 | RFMDLSSVLE | PGRTPKTDKP | AILDDAIRIL | NQLRDEALKL | EETNQKLLEE | 192 |
| CeresClone:590996 | RFCDLSSVLE | PGRPVRTDKP | AILDDAIRVL | SQLKTEAQEL | KKTNEKLLEE | 129 |
| CeresClone:631135 | RFCDLSSVLE | PGRPVRTDKP | AILDDAIRVL | SQLKTEAQEL | KKTNEKLLEE | 129 |
| Consensus | RF-DLSSVLE | PGR---TDKP | AILDDAIR-L | -QL---EA--L | --TN-KLLEE | 200 |

| Lead-CeresClone40736 | KSLKAEKNE | LREEKLVLKA | DKEKTEQQLK | SMTAPSSGFI | PH------PAA | 244 |
| gi\|20127109 | KSLKAEKNE | LREEKLVLKA | DKEKTEQQLK | SMTAPSSGFI | PH------PAA | 238 |
| CeresClone:590996 | KCLKAEKNE | LREEKLVLKA | DKERIEKQLK | ALPVAPAGFM | APPVA----AAAA | 179 |
| CeresClone:631135 | KCLKAEKNE | LREEKLVLKA | DKEKIEKQLK | ALPVAPAGYM | TPPV----AAAA | 177 |
| Consensus | IK-LKAEKNE | LREEKLVLKA | DKE---E-QLK | ---------- | ------AA | 250 |

Figure 76 (Continued)

| | | | | | |
|---|---|---|---|---|---|
| Lead-CeresClone40736 | FNH--NKMAV | YPSYGYMPMW | HYMPQSVRDT | SRDQELRPPA | A 283 |
| gi\|20127109 | FNH--NKMAV | YPSYGYMPMW | HYMPQSVRDT | SRDQFLRPPA | A 277 |
| CeresClone:590996 | YQAGVNKMAV | YPNYGYIPMW | QYLPQSVRDT | SHDHELRPPA | A 220 |
| CeresClone:631135 | YQAGVNKMAL | YPNYGYIPMW | QYLPQSVRDT | SHDHELRPPA | A 218 |
| Consensus | ----GVNKMAV | YP-YGY-PMW | -Y-PQSVRDT | S-D-ELRPPA | A 291 |

Figure 77

```
gi|50929277         MEP-----------T SSAAMARQTW ELENNI PAAA --------- ------ALDA   32
gi|120002865        MDA---LNSYA--   SSAAMAQQTW ELENNI VTTD --------- ------ASDA   42
gi|3320379          MEA------SSS-   SSSAI AQQTW ELENNI I PME TP-------- ------SDDS   32
CeresClone:529894   MQGKEMEGLS--    SSSAI AQKTW ELENNI I PMD TPGGAATSST ATTTTNADDS   50
gi|21700803         MEG---------    SSSTI ARKTW ELENSI LTVD SPDS------ ------TSDN   31
gi|3641312          MEG---------    SSSTI ARKTW ELENSI LTVD SPDS------ ------TSDN   31
Lead-CeresClone42713 MEG---------   SSSAI ARKTW ELENNI LPVE PTDS------ ------ASDS   31

Consensus           MEG--------S    SSSAI ARKTW ELENNI I-VD SP-------- ------ASDS   50 gi|50929277         YRYDEAAQA       RVQQEKPWAN DPHPFRRAKI SALALLKMVV HARAGGTI EV   82
gi|120002865        FHYDEAAQT       KFQREKPWTS DPHYFKRVKI SALALLKMVV HARSGGTI EV   92
gi|3320379          FHYDEAGQA       EFQRDKPWAN DPHYFKRVKI SALALLKMVV HARSGGTI EV   82
CeresClone:529894   FYYDEAGQN       EFQRDKPWAN DPHYFKRVKI SALALLKMVV HARSGGTI EV  100
gi|21700803         FYYDDTSQT       RFQQEKPWEN DPHYFKRVKI SALALLKMVV HARSGGTI EI   81
gi|3641312          FYYDDTSQT       RFQQEKPWEN DPHYFKRVKI SALALLKMVV HARSGGTI EI   81
Lead-CeresClone42713 FHYDDASQA      KI QQEKPWAS DPNYFKRVHL SALALLKMVV HARSGGTI EI   81

Consensus           IF-YDDASQ-      -FQQEKPWAN DPHYFKRVKI SALALLKMVV HARSGGTI EV  100 gi|50929277         MGLMQGKCEG      DA- VVMDAFA LPVEGTETRV NAQADAYEYM VEYSTI NKQA  132
gi|120002865        MGLMQGKTDG      DA- I VMDAFA LPVEGTETRV NAQADAYEYM VEYSQTNKQA  142
gi|3320379          MGLMQGKTDA      DSI I VMDAFA LPVEGTETRV NAQADAYEYM VDYSQTNKQA  132
CeresClone:529894   MGLMQGKTDA      DA- I VMDAFA LPVEGTETRV NAQADAYEYM VDYSQTNKQA  150
gi|21700803         MGLMQGKTDG      DTI I VMDAFA LPVEGTETRV NAQDDAYEYM VEYSQTNKLA  131
gi|3641312          MGLMQGKTDG      DTI I VMDAFA LPVEGTETRV NAQDDAYEYM VEYSQTNKLA  131
Lead-CeresClone42713 MGLMQGKTEG     DTI I VMDAFA LPVEGTETRV NAQSDAYEYM VEYSQTSKLA  131

Consensus           MGLMQGKTDG      D-I I VMDAFA LPVEGTETRV NAQADAYEYM VEYSQTNKQA  150
```

Figure 77 (Continued)

| | | | | | | |
|---|---|---|---|---|---|---|
| gi\|50929277 | GRLENVVGWY | HSHPGYGCWL | SGIDVSTQML | NQQFQEPFLA | VVIDPTRTVS | 182 |
| gi\|12002865 | GRLENVVGWY | HSHPGYGCWL | SGIDVTTQML | NQQYCEPFLA | VVIDPTRTVS | 192 |
| gi\|3320379 | GRLENVVGWY | HSHPGYGCWL | SGIDVSTQML | NQQFQEPFLA | VVIDPTRTVS | 182 |
| CeresClone:529894 | GRLENVVGWY | HSHPGYGCWL | SGIDVSTQML | NQQHQEPFLA | VVIDPTRTVS | 200 |
| gi\|21700803 | GRLENVVGWY | HSHPGYGCWL | SGIDVSTQRL | NQQHQEPFLA | VVIDPTRTVS | 181 |
| gi\|3641312 | GRLENVVGWY | HSHPGYGCWL | SGIDVSTQTL | NQQYQEPFLA | VVIDPTRTVS | 181 |
| Lead-CeresClone42713 | GRLENVVGWY | HSHPGYGCWL | SGIDVSTQML | NQQYQEPFLA | VVIDPTRTVS | 181 |
| Consensus | GRLENVVGWY | HSHPGYGCWL | SGIDVSTQML | NQQ-QEPFLA | VVIDPTRTVS | 200 |

| | | | | | | |
|---|---|---|---|---|---|---|
| gi\|50929277 | AGKVEIGAFR | TYPKDYKPPD | EPVSEYQTIP | LNKIEDFGVH | CKQYYALDIT | 232 |
| gi\|12002865 | AGKVEIGAFR | TYPEGYKPPD | DPISEYQTIP | LNKIEDFGVH | CKQYYSLDIT | 242 |
| gi\|3320379 | AGKVEIGAFR | TYPEGYKPAD | DPISEYQTIP | LNKIEDFGVH | CKQYYSLDIT | 232 |
| CeresClone:529894 | AGKVEIGAFR | TYPEGYKPPD | EPISEYQTIP | LNKIEDFGVH | CKQYYALDIT | 250 |
| gi\|21700803 | AGKVEIGAFR | TYSKGYKPPD | EPVSEYQTIP | LNKIEDFGVH | CKQYYSLDVT | 231 |
| gi\|3641312 | AGKVEIGAFR | TYSKGYKPPD | EPVSEYQTIP | LNKIEDFGVH | CKQYYSLDVT | 231 |
| Lead-CeresClone42713 | AGKVEIGAFR | TYPEGHKISD | DHMSEYQTIP | LNKIEDFGVH | CKQYYSLDIT | 231 |
| Consensus | AGKVEIGAFR | TYPEGYKPPD | EPVSEYQTIP | LNKIEDFGVH | CKQYYSLDIT | 250 |

| | | | | | | |
|---|---|---|---|---|---|---|
| gi\|50929277 | YFKSSLDSHL | LDLLWNKYWV | NTLSSSPLLG | NRDYVAGQIF | DLADKLEQAE | 282 |
| gi\|12002865 | YFKSSLDSHL | LDLLWNKYWV | NTLSSSPLLE | NGDYVAGQIS | DLAEKMEQAE | 292 |
| gi\|3320379 | YFKSSLDSHL | LDLLWNKYWV | NTLSSSPLLG | NGDYVAGQIS | DLAEKLEQAE | 282 |
| CeresClone:529894 | YFKSSLDCHL | LDLLWNKYWV | NTLSSSPLLG | NGDYVAGQIS | DLAEKLEQAE | 300 |
| gi\|21700803 | YFKSSLDSHL | LDLLWNKYWV | NTLSSSPLLG | NGDYVAGQIS | DLAEKLEQAE | 281 |
| gi\|3641312 | YFKSSLDSHL | LDLLWNKYWV | NTLSSSPLLG | NGDYVAGQIS | DLAEKLEQAE | 281 |
| Lead-CeresClone42713 | YFKSSLDSHL | LDLRNKYWV | NTLSSSPLLG | NGDYVAGQIS | DLAEKLEQAE | 281 |
| Consensus | YFKSSLDSHL | LDLLWNKYWV | NTLSSSPLLG | NGDYVAGQIS | DLAEKLEQAE | 300 |

Figure 77 (Continued)

```
gi|50929277        GQLAHSRYGM LMPSQ-RKKE QEESPLAKVT RDSSKITAEQ VHGLMSQVIK   331
gi|120002865       NHLSHSRFGH LVAAP-QRKK EEESPLAKIT RDSAKITVEQ VHGLMSQVIK   341
gi|3320379         NQLAHSRFGP LVAPT-PRKK EEESPLAKIT RDSAKITVEQ VHGLMSQVIK   331
CeresClone:529894  NQLAHSRFGP LIAPT-PRKK EEESPLAKIT RDSAKITVEQ VHGLMSQVIK   349
gi|21700803        SHLVQSRFGG VVPSSLHKKK EDESQLTKIT RDSAKITVEQ VHGLMSQVIK   331
gi|3641312         SHLVQSRFGG VVPSSLHKKK EDESQLTKIT RDSAKITVEQ VHGLMSQVIK   331
Lead-CeresClone42713 SQLANSRYGG IAPAGHQRRK EDEPQLAKIT RDSAKITVEQ VHGLMSQVIK 331

Consensus         -QLAHSRFG- LVPS----RKK EEESQLAKIT RDSAKITVEQ VHGLMSQVIK   350 gi|50929277        DILFNSVHPS -NKASTSAPD SSGPEPMVEA   360
gi|120002865       DILFNSVCKS -GKSQT---E PSDPEPMVET   367
gi|3320379         DILFNSVHQA -NKSHT---E TSDPEPMIES   357
CeresClone:529894  DILFNSVHQA -NRTRT---E PSGPEPMIES   375
gi|21700803        DELFNSMRQS NNKSPT---D SSDPDPMITY   358
gi|3641312         DELFNSMRQS NNKSPT---D SSDPDPMITY   358
Lead-CeresClone42713 DILFNSARQS -KKSAD---D SSDPEPMITS   357

Consensus         DILFNSV-QS -NKS-T---D SSDPEPMIES   380
```

Figure 78 (Continued)

| | | | | | | |
|---|---|---|---|---|---|---|
| Lead-CeresClone42960 | EIRDPREGAR | IWLGTFKITAE | EAARAYDAAA | RRIRGSKAKV | NFPEENLKAN | 188 |
| gi\|33331083 | EIRDPRKGVR | VWLGTFSTAE | EAARAYDAEA | RRIRGKKAKV | NFPDEPSGAA | 181 |
| gi\|30961941 | EIRDPRKGVR | VWLGTFNTAE | EAARAYDVEA | RRIRGNKAKV | NFPDEAPVPA | 180 |
| gi\|22074046 | EIRDPRKGIR | VWLGTFNSAE | EAARAYDAEA | RRIRGKKAKV | NFPDEAPVSV | 166 |
| gi\|37954364 | EIRDPRKGIR | VWLGTFNSAE | EAARAYDVEA | RRIRGKKAKV | NFPDGSPASA | 168 |
| gi\|57117316 | EIRDPRKGVR | VWLGTFNTAE | EAARAYDAEA | RRIRGKKAKV | NFPDEAPCAS | 184 |
| gi\|62526569 | EIRDPRKGVR | VWLGTFNTAE | EAARAYDSEA | RRIRGKKAKV | NFPDEAPRAS | 179 |
| gi\|38343926 | EIRDPRKGVR | VWLGTFNTAE | KAARAYDAEA | RRIRGKKAKV | NFPDETPRAS | 173 |
| Consensus | EIRDPRKGVR | VWLGTFNTAE | EAARAYDAEA | RRIRGKKAKV | NFPDEAP-A- | 200 |

| | | | | | | |
|---|---|---|---|---|---|---|
| Lead-CeresClone42960 | SQKRSVKANL | QKPVAK---- | ------PNPNPSP | ALVQNSNISF | -ENMCFMEEK | 230 |
| gi\|33331083 | S-SKRLKANP | EAQPMKKNLN | SVKPKINQMF | NFGDN-EGYY | -SPIDQVEQK | 229 |
| gi\|30961941 | S-RRTVKVNP | QKVLPKEILD | SVQPDST--- | --NNMEDCC | YDSLGFLEEK | 225 |
| gi\|22074046 | S-RRAIKQNP | QKALREETLN | TVQPNMT--- | -YISNLDGGS | DDSFSFFEEK | 211 |
| gi\|37954364 | S-RRAVKPNP | QEALREEILN | TVQPNTT--- | -YISNNLDGGS | DDSEGFFEEK | 213 |
| gi\|57117316 | A-RHPIKENS | QKRLTK---- | -ANLSQDF | SYLSNPETDY | -NNMGFVEEK | 225 |
| gi\|62526569 | P-KRTMKANP | QKPLPK---- | -RNATESM | SYLNNPDQDY | FNTLGSVDEK | 221 |
| gi\|38343926 | P-KRSVKANL | QKPLAKANLN | SVQPNLNQNF | NFMNNSDQDY | --TMGLMEEK | 220 |
| Consensus | S-RR-VKANP | QK-L-KE-LN | SVQPNMTQ-- | -YINNMD--Y | -DSMGFMEEK | 250 |

| | | | | | | |
|---|---|---|---|---|---|---|
| Lead-CeresClone42960 | HQVSNNNNNQ | FGMTNSVDAG | CN------ | ------GYQYFS | SDQGSNSFDC | 268 |
| gi\|33331083 | PLV----- | Y-VNRAPFAG | NGVQVSPVTP | SAD-VTAYFS | SEHSSNSFDY | 272 |
| gi\|30961941 | PMT----KQ | FGCEDGSSAS | GDTGFGSFAP | SAG-TDIYFN | SDVGSNSFDC | 269 |
| gi\|22074046 | PAT----KQ | YGFENVSFTA | VDMGLGSVSP | SAG-TNVYFS | SDEASNTFDC | 255 |
| gi\|37954364 | PAA----KQ | YGYENVSFTA | GDMGLGSISP | STGT-TNVYFS | SDEGSNTFDC | 258 |
| gi\|57117316 | PQV----SQ | FGIMNSIPVN | GDSGVTPLTP | SDN-ASMYFN | SDKGSNSFDC | 269 |
| gi\|62526569 | PLV----SQ | FDLMDSFPAN | GDATVKSIPP | CDN-VPTFFN | SDQGSNSFEC | 265 |
| gi\|38343926 | PFT----NQ | YGYMDSIPAN | ADVGLKPFAS | NN--ITPYFN | SDQGSNSFDC | 263 |
| Consensus | P-V------NQ | -G---NS--A- | GD-G--S--P | S----T-VYF- | SDQGSNSFDC | 300 |

Figure 79

| | | | | | | |
|---|---|---|---|---|---|---|
| CeresClone:1360570 | MSSEQNNSTS | FPPTEPKLCD | NGCGFFGSPS | NMNLCSKCYR | SLRAEEDQTA | 50 |
| Lead-CeresClone45 | MGEENNSTS | FPPTEPKLCD | NGCGFFGSPS | NMNLCSKCYR | SLRAEEDQTA | 50 |
| CeresClone:962327 | MSSEQNNSTS | FPPTEPKLCD | NGCGFFGSPS | NMNLCSKCYR | SLRAEEDQTA | 50 |
| Consensus | MSSEQNNSTS | FPPTEPKLCD | NGCGFFGSPS | NMNLCSKCYR | SLRAEEDQTA | 50 |
| CeresClone:1360570 | VAKAAVEKSL | KLPSCNLITA | PEPKQPLETK | PASLETVVIA | GTSSVPPVAT | 100 |
| Lead-CeresClone45 | VAKAAVKNSL | KLPSCSIIA | PGQKHPLEDK | PAHLETVVVT | AEPSSVPVAA | 99 |
| CeresClone:962327 | VAKAAVKNSL | KLPSCSLIIT | PEQKQPLETK | PA---SVVVT | AEPSSVPIAT | 97 |
| Consensus | VAKAAVKNSL | KLPSCSLIIA | PEQKQPLETK | PA-LETVVVT | AEPSSVPVAT | 100 |
| CeresClone:1360570 | GQDEGEPSKP | TRP-NRCFSC | NKKVGVMGFK | CKCGSTFCGS | HRYPEKHECS | 149 |
| Lead-CeresClone45 | EQDEAEPSRP | VRPN-NRCFSC | NKKVGVMGFK | CKCGSTFCGS | HRYPEKHECS | 149 |
| CeresClone:962327 | GQEEAEPSKP | ART-NRCFSC | NKKVGVMGFK | CKCGSTFCGS | HRYPEKXECS | 146 |
| Consensus | GQDEAEPSKP | -RP-NRCFSC | NKKVGVMGFK | CKCGSTFCGS | HRYPEKHECS | 150 |
| CeresClone:1360570 | FDFKEVGRGA | IAKANPVVKA | DKVQRI | | | 175 |
| Lead-CeresClone45 | FDFKEVGRDA | IAKANPLVKA | DKVQRI | | | 175 |
| CeresClone:962327 | FDFKXVGRDA | IAKANPVIKA | DKVERI | | | 172 |
| Consensus | FDFKEVGRDA | IAKANPVVKA | DKVQRI | | | 176 |

Figure 80

```
                          MVVI ELEPEE ------ATR PSSPAS----- ----------- ----EEKAAAA      26
CeresClone:246144         MVLI EHEESK ------- QRNAN----- ---------DDS DGFETASDTD      34
Lead-CeresClone471089     MVLI ESSESE DEILI KNEPK PASSSSPQPT ETKQVDGDDS DGFETASERE      50
gi|21537266

Consensus                 MVLI E-EESE ----------- PSS-AS----- -------DDS DGFETAS----      50

AGGEAARPSS SAAPEEAPTA AAAAVGGEAS RAA------G EEEEAFEDAI       70
CeresClone:246144         LAGE-GDDSG AGI PEEQNRT EQSHTEKQTE QEPEHDAPRS SKSSENNALI       83
Lead-CeresClone471089     SDEEGEEDG TKNDAVTSQE EPQHSEKKEE Q--------I ELMSEGEAIV       92
gi|21537266

Consensus                 ---GE-G--SG ----PEE---- E---H-EK--E Q---------- E---SE-EA--     100

TDEQLREKSR SQANDAKAEG NKFFGSGQYE EALSKYEMAL QIAAELESSE      120
CeresClone:246144         SEEESRQKAL NQANEAKVEG NKLFVEGKYE EALLQYELAL QAAPDMPSSV      133
Lead-CeresClone471089     DDGSNKEKAL AEANEAKAEG NKLFVNGLYE EALSKYAFAL ELVQELPESI      142
gi|21537266

Consensus                 -DE---REKAL -QANEAKAEG NKLFV-G-YE EALSKYE-AL Q-A-ELPSS-     150

DI RAACHSNR AVCFLKLGKH DETVKECTKA LELNPSYLKA LRRAEAHEK      170
CeresClone:246144         EI RSI CHSNR GVCFLKLGKY DNTI KECTKA LELNPVYI KA LVRRGEAHEK      183
Lead-CeresClone471089     ELRSI CYLNR GVCFLKLGKC EETI KECTKA LELNPAYNKA LVRRAEAHEK      192
gi|21537266

Consensus                 EI RSI CHSNR GVCFLKLGK- DETI KECTKA LELNP-Y-KA LVRRAEAHEK     200

LEHYDEAI AD MKKVI EMDPS NQQAIRSLFR LEPLAAEKRE KMKEEMI GKL      220
CeresClone:246144         LEHFEEAI AD MKKI LEI DLS NDQARKTI RQ LEPLAAEKRE KMKEEMI AKL      233
Lead-CeresClone471089     LEHFEDAVTD LKKI LELDPS NDQARKGI RR LEPLAAEKRE KMKEEAI TKL      242
gi|21537266

Consensus                 LEHFEEAI AD MKKI LE-DPS NDQARK-I RR LEPLAAEKRE KMKEEMI -KL     250

KDLGNSVLGR FGMSVDNFKA VKDPNTGSYS IQFQK               255
CeresClone:246144         KDMGNSVLGR FGMSVDNFKA VKDPNTGSYS ISFQR               268
Lead-CeresClone471089     KEMGNSI LGR FGMSVDNFKA VKDPNTGSYS LSFQN               277
gi|21537266

Consensus                 KDMGNSVLGR FGMSVDNFKA VKDPNTGSYS ISFQ-               285
```

Figure 81 (Continued)

| | | | | | | | |
|---|---|---|---|---|---|---|---|
| gi\|50251896 | NRKTSASEFC | APLTSFDWNE | AEPRRIGTAS | DTTCTIWDI | ERGVVETQLI | 183 |
| CeresClone:783774 | NRKASASDFC | APLTSFDWNE | LEPRRIGTAS | DTTCTIWDI | ERGVVETQLI | 184 |
| gi\|37544703 | NRKAS-SEFC | APLTSFDWNE | VEPRRIGTAS | DRTCTIWDI | DRGVVETQLI | 181 |
| CeresClone:1151902 | NSKTS---EFC | APLTSFDWNE | VEPKRLGTCS | DTTCTIWDI | EKSVVETQLI | 172 |
| gi\|10636051 | NSKTS---EFC | APLTSFDWNE | VEPKRLGTCS | DTTCTIWDI | EKSVVETQLI | 172 |
| gi\|22324807 | NSKTS---EFC | APLTSFDWNE | VEPKRIGTSS | DTTCTIWDI | EKCVVETQLI | 176 |
| gi\|14270085 | NSKTS---EYS | APLTSFDWNE | VEPKRIGTSS | DTTCTIWDI | EKGAVETQLI | 164 |
| Lead-CeresClone475689 | NSKTS---EYC | APLTSFDWND | IDPNRIATSS | DTTCTIWDI | ERTLVETQLI | 166 |
| gi\|2290532 | NSKTS---EFC | APLTSFDWNE | VEPKRIGTSS | DTTCTIWDV | EKGVVETQLI | 168 |
| gi\|6752886 | NSKTS---EFC | APLTSFDWND | IEPRRIGTSS | DTTCTIWDI | EKGVVETQLI | 173 |
| Consensus | NSKTS---EFC | APLTSFDWN- | VEPRRIGTSS | IDTTCTIWDI | EKGVVETQLI | 200 |

| | | | | | | | |
|---|---|---|---|---|---|---|---|
| gi\|50251896 | AHDKAVHDIA | WGENGIFASV | SADGSVRVFD | LRDKEHSTIF | YESPRPDTPL | 233 |
| CeresClone:783774 | AHDKAVHDIA | WGEAGVFASV | SADGSVRVFD | LRDKEHSTIV | YESPRPDTPL | 234 |
| gi\|37544703 | AHDKAVHDIA | WGEARVFASV | SADGSVRVFD | LRDKEHSTIV | YESPRPDTPL | 231 |
| CeresClone:1151902 | AHDKEVHDIA | WGEARVFASV | SADGSVRIFD | LRDKEHSTI- | YESPQDTPL | 222 |
| gi\|10636051 | AHDKEVHDIA | WGEARVFASV | SADGSVRIFD | LRDKEHSTI- | YESPQDTPL | 222 |
| gi\|22324807 | AHDKEVYDIA | WGEAGVFASV | SADGSVRIFD | LRDKEHSTI- | YESPQPDTPL | 226 |
| gi\|14270085 | AHDKEVYDIA | WGEARVFASV | SADGSVRIFD | LRDKEHSTI- | YESPMPDTPL | 214 |
| Lead-CeresClone475689 | AHDKEVYDIA | WGEARVFASV | SADGSVRIFD | LRDKEHSTI- | YESPHPDTPL | 216 |
| gi\|2290532 | AHDKEVYDIA | WGEAGVFASV | SADGSVRIFD | LRDKEHSTI- | YESPTPDTPL | 218 |
| gi\|6752886 | AHDKEVYDIA | WGEARVFASV | SADGSVRIFD | LRDKEHSTI- | YESPQPDTPL | 223 |
| Consensus | AHDKEV-DIA | WGEA-VFASV | SADGSVRIFD | LRDKEHSTI- | YESPQPDTPL | 250 |

| | | | | | | | |
|---|---|---|---|---|---|---|---|
| gi\|50251896 | LRLAWNRYDF | HYMATLLMDS | SAVVVLDMRA | PGVPVAELHR | HRACANAVAW | 283 |
| CeresClone:783774 | LRLAWNRYDL | RYMAALLMDS | NAVVVLDIRA | PGVPVAELHR | HGGCVNAVAW | 284 |
| gi\|37544703 | LRLAWNRSDL | RYMAALLMDS | SAVVVLDIRA | PGVPVAELHR | HRACANAVAW | 281 |
| CeresClone:1151902 | LRLAWNKQDL | RYMATILMDS | NKVVILDIRS | PTMPVAELER | HQASVNAIAW | 272 |
| gi\|10636051 | LRLAWNKQDL | RYMATILMDS | NKVVILDIRS | PTMPVAELER | HQASVNAIAW | 272 |
| gi\|22324807 | LRLAWNKQDL | KYMATILMDS | NKVVILDIRS | PTIPVAELER | HHASVNAIAW | 276 |
| gi\|14270085 | LRLAWNKQDL | RYMATILMDS | NKIVILDIRS | PTMPVAELER | HSASVNAIAW | 264 |
| Lead-CeresClone475689 | LRLAWNKQDL | RYMATILQMDS | NKVVILDIRS | PTTPVAELER | HRGSVNAIAW | 266 |
| gi\|2290532 | LRLAWNKQDL | RYMATILMDS | NKVVILDIRS | PAMPVAELER | HQASVNAIAW | 268 |
| gi\|6752886 | LRLAWNKQDL | RYMATILMDS | NKVVILDIRS | PTMPVAELER | HRGSVNAIAW | 273 |
| Consensus | LRLAWNKQDL | RYMATILMDS | NKVVILDIRS | PTMPVAELER | HRASVNAIAW | 300 |

Figure 82

| Sequence | Alignment 1 | | | | | Pos |
|---|---|---|---|---|---|---|
| gi\|49658405 | ---- | ---- | ---- | MDMFFS | QLSDSVDQPQ | |
| Lead-CeresClone481710 | ---- | MFTLNHSSDL | YHVSPELSSS | LDTSSPASEG | SRGVAFSDEE | -VRLAVRHPK | 45 |
| CeresClone:1620272 | ---- | MYTLNHSSYL | YHVSPELSSS | LDSSSPASEG | SRGVAFSDEE | -VRLAVRHPK | 49 |
| gi\|10177734 | ---- | ---- | --MNPFYSTF | PDSFLSI SDH | RSPVSDSSEC | SPKLASSCPK | 49 |
| CeresClone:1052602 | ---- | ---- | --MDPFYTSF | SDSFLSIPDH | RSPVSDSSEC | SPKLASSCPK | 38 |
| gi\|5616086 | ---- | ---- | --MTSFSTF | SEMLGSEYES | PVTLG-GEYC | -PKLAASCPK | 38 |
| gi\|38426952 | ---- | ---- | --MTSFSAF | SEMMGSENES | P-ALSI-GEYC | -PKLAASCPK | 35 |
| gi\|38146944 | ---- | ---- | --MTSFSAF | SELLGSEHES | PVTLG--EEYC | -PTLAASCPK | 34 |
| gi\|38426948 | ---- | ---- | --MTSFSAF | SEMLGSEYES | P-TLSI-GEYC | -PKLAASCPK | 35 |
| gi\|38683266 | ---- | ---- | --MTSFSAF | SEMFGSEYES | PVSSGGGDYC | -PTLAASCPK | 34 |
| gi\|41351817 | ---- | ---- | --MNSSFSAF | AEMFGSEYES | PVTVC-GDYC | -PTLATSCPK | 37 |
| gi\|12003384 | ---- | ---- | --MNSFSAF | SSLSDSSSSS | CNRANHSDEE | -VMLASNNPK | 35 |
| gi\|12003382 | ---- | MDIFRS | YYSDP-LAEY | SSFSDSSIYS | ---- | -MLASNNPK | 44 |
| gi\|37147896 | ---- | ---- | YYSDPLTESS | ESC | PNRAIFSDEE | -VILASNNPK | 8 |
| gi\|45826358 | ---- | MNIFRS | FYSDPRIESC | ---- | --RANHSDEE | -VILASNNPK | 45 |
| Consensus | | | ---FS-F | SEM--S--ES | ---VS-SD-C | -P-LASSCPK | 50 |

| Sequence | Alignment 2 | | | | | Pos |
|---|---|---|---|---|---|---|
| gi\|49658405 | KRAGRRVFKE | TRHPVYRGVR | RRNNDKWVCE | MREPN-KKSR | WLGTYPTAE | 95 |
| Lead-CeresClone481710 | KRAGRKKFRE | TRHPVYRGVR | RRNSDKWVCE | VREPN-KKTR | WLGTFPTPE | 98 |
| CeresClone:1620272 | KRAGRKKFRE | TRHPVYRGVR | RRNTDKWVSE | VREPN-KKTR | WLGTFPTPE | 98 |
| gi\|10177734 | KRAGRKKFRE | TRHPIYRGVR | QRNSGKWVCE | VREPN-KKSR | WLGTFPTVE | 87 |
| CeresClone:1052602 | KLAGRKKFRE | TRHPIYRGVR | QRNSGKWVCE | VREPN-KKSR | WLGTFPTVE | 87 |
| gi\|5616086 | KPAGRKKFRE | TRHPIYRGVR | LRNSGKWVCE | VREPN-KKSR | WLGTFLTAE | 84 |
| gi\|38426952 | KPAGRKKFRE | TRHPIYRGVR | QRHSGKWVCE | VREPN-KKSR | WLGTFLTAE | 83 |
| gi\|38146944 | KPAGRKKFRE | TRHPIYRGVR | LRNSGKWVCE | VREPN-KKSR | WLGTFLTAE | 84 |
| gi\|38426948 | KPAGRKKFRE | TRHPIYRGVR | LRNSGKWVCE | VREPN-KKSR | WLGTFLTAE | 83 |
| gi\|38683266 | KPAGRKKFRE | TRHPVYRGVR | RRNSGKWVCE | VREPN-KKSR | WLGTFPTAE | 86 |
| gi\|41351817 | KPAGRKKFRE | TRHPVYRGVR | RRNSGKWVCE | VREPN-KKSR | WLGTFPTAD | 84 |
| gi\|12003384 | KRAGRKKLRE | TRHPVYRGVR | LRNSGKWVCE | LREPN-KKSR | WLGTFPSAE | 84 |
| gi\|12003382 | KRAGRKKLFE | TRHPVYRGVR | RRNSGKWVCE | VEPN-KQSR | WLGTFPSAE | 93 |
| gi\|37147896 | KPAGRKKFRE | TRHPVYRGVR | KRNSGKWVCE | VREPN-KKSR | WLGTFPTAE | 57 |
| gi\|45826358 | KPAGRKKFRE | TRHPVYRGVR | KRNSGKWVCE | VREPN-KKTR | WLGTFPTAE | 94 |
| Consensus | KPAGRKKFRE | TRHPVYRGVR | RRNSGKWVCE | VREPN-KKSR | IWLGTFPTAE | 100 |

Figure 82 (Continued)

| | | | | | | |
|---|---|---|---|---|---|---|
| gi\|49658405 | MAARAHDVAA | LAFRGKLACI | NFADSAWRLP | VPASMDTMDI | RRAAAEAAEG | | 145 |
| Lead-CeresClone481710 | MAARAHDVAA | MALRGRYACL | NFADSAWRLP | VPATAEAKDI | QKAAAEAAQA | | 148 |
| CeresClone:1620272 | MAARAHDVAA | MALRGRYACL | NFADSTWRLP | PATANAKDI | QKAAAEAAEA | | 148 |
| gi\|10177734 | MAARAHDVAA | LALRGRSACL | NFADSAWRLR | PETTCPKEI | QKAASEAAMA | | 137 |
| CeresClone:1052602 | AARAHDVAA | LALRGRSACL | NFADSAWRLR | PESTCPKEI | QKAAAEAAMA | | 134 |
| gi\|5616086 | AARAHDVAA | ALRGKSACL | NFADSAWRLR | PETTCPKEI | QKAAAEAALA | | 133 |
| gi\|38426952 | AARAHDVAA | ALRGKSACL | NFADSAWRLR | PETTCPKDI | QKAAAEAAVA | | 134 |
| gi\|38146944 | AARAHDVAA | ALRGKSACL | NFADSAWRLR | PETTCPKDI | QKAAAEAAVA | | 133 |
| gi\|38426948 | MAARAHDVAA | ALRGRSACL | NFADSAWRLR | PESTGAKEI | QKAAAEAALA | | 136 |
| gi\|38683266 | MAARAHDVAA | ALRGRSACL | NFADSAWRLR | PESTCAKDI | QKAAAEAAVA | | 134 |
| gi\|41351817 | MAARAHDVAA | ALRGRSACL | NFADSAWKLP | PASTDAKDI | QKAAAEAAEA | | 143 |
| gi\|12003384 | MAVRAHDVAA | ALRGRSACL | NFADSAWKLH | PASTDAKDI | QKAAAEAAEA | | 107 |
| gi\|12003382 | MAARAHDVAA | ALRGRSACL | NFADSAWRLP | V.ASSDTKDI | QKAAAEAAEA | | 144 |
| gi\|37147896 | MAARAHDVAA | ALRGRSACL | NFADSAWRLP | TPDSSDTKDI | QKAAAQAAEI | | 134 |

Consensus  MAARAHDVAA I ALRGRSACL NFADSAWRLR I PETT--KDI QKAAAEAAVA  150

| | | | | | | |
|---|---|---|---|---|---|---|
| gi\|49658405 | FRPVEFGGVC | SGSSDEKERM | VVQVEEKNKK | GSVNLERSRS | LSLSYMD-EE | | 194 |
| Lead-CeresClone481710 | FRPDQ---TL | KNANTRQECV | EA--VAVAVA | ETTT-ATAQ- | GVFYMEEEE | | 190 |
| CeresClone:1620272 | FRPSQ---TL | ENTNTKQECV | KV--VTTT- | -TIT-EQKR- | GMFYMEEEE | | 187 |
| gi\|10177734 | FQNET----TT | EGSKTAAEAE | EAAGEGVREG | ERRAEEQNG- | GVFYMD-DE | | 181 |
| CeresClone:1052602 | FQNK----TA | TLETTMVEAV | KP--AEETVG | QTGG-EITMEE | NGVFYMA-- | | 179 |
| gi\|5616086 | FQAE---T- | NNT-T-TDHGL | DM--EETIVE | AI FT-EENN- | DVFYMDEEE | | 172 |
| gi\|38426952 | FQAE---T- | NDT-T-TADHGI | DV--EETIVE | AI FT-EENN- | DGFYMDEEE | | 172 |
| gi\|38146944 | FQAE---T- | NDT-T-TDHGL | DV--EETIVE | AI FT-EENN- | DGFYMDEEE | | 173 |
| gi\|38426948 | FQDEM----MM | SDTITTDHGF | DM--EETTVE | AI FT-EENS- | DGFYMDEEE | | 172 |
| gi\|38683266 | FQAE----M | SDTMISDHGL | DM--EETTVE | AI VI-AEQS- | ASLYID--EE | | 177 |
| gi\|41351817 | FRSS----E | AENMPEYSGE | DT--KEVN-- | VI VIEEEQS- | EGFYMD-EE | | 174 |
| gi\|12003384 | FRTS----E | AENMPEYSGE | DS--KEVN-- | ---STPE- | NMFYMD-EE | | 176 |
| gi\|12003382 | FRPL----K | LE----GI | SK--ESSS-- | ---STPE- | NMFFMD-EE | | 140 |
| gi\|37147896 | FRPL----K | SEE------ | ------ | ---STPE- | SMFFMD-EE | | 171 |
| gi\|45826358 | FRPL | | EESVK | DQST--TPD- | DMFFMD-EE | | 163 |

Consensus  FQ-E-----M  -D---T-----GI  DV---EET-VE  ---T--E----  --MFYMD-EE  200

Figure 82 (Continued)

| | | | | | | | |
|---|---|---|---|---|---|---|---|
| gi|49658405 | EVFHMPRLLH | DMAEGLLLSP | SQC-LGGYMN | LDDMGT- | DAD | MKLWSFSI | 240 |
| Lead-CeresClone481710 | QVLDMPELLR | NM------VLMSP | THC-LGYEYE | DADLDAQDAE | | VSLWNFSI | 234 |
| CeresClone:1620272 | QVLDMPELLR | NM------VLMSP | THC-IGYEYE | DADLDAQDAE | | VSLWSFSI | 231 |
| gi|10177734 | ALLGMPNFFE | NMAEGMLLPP | PEVGWNHN-D | F-----VGD | | VSLWSFDE | 224 |
| CeresClone:1052602 | AVLGMPRFLE | NMGEEMLLPP | PELGWNHN-D | LAG----- | DAD | VSLWSF-- | 220 |
| gi|5616086 | SMLEMPALLA | SMAEGMLLPP | PSVHFGHNYD | FDG----- | DAD | VSLWSY-- | 214 |
| gi|38426952 | SMFGMPALLA | SMAEGMLLPP | PSVQFGHITY | FDG----- | DAD | VSLWSY-- | 214 |
| gi|38146944 | SMFGMPSLVA | SMAEGMLLPP | PSVRFEHNYD | FDG----- | DAD | VSLWSY-- | 215 |
| gi|38426948 | SMFGMPTLLA | SMAEGMLLPL | PSVQFEYNYD | I-DG----- | DAD | VSLWSY-- | 214 |
| gi|38683266 | DMFGMPSLMA | SMAEGMLLPL | PSVQWNHNYD | CDG----- | DTD | VSLWSY-- | 219 |
| gi|41351817 | AMFGMPRLLA | NMAEGMLLPP | PSVQWGHNYD | EA----- | DAD | VSLWSY-- | 216 |
| gi|12003384 | ALFFMPGLLV | NMAEGMLMLPP | PQCSQIGDHM | ED----- | DVD | MPLWSYSI | 219 |
| gi|12003382 | ALFCMPGLLN | NMAEGMLMLPP | PQCSQIGDHM | EA----- | DFD | MPLWSYSI | 183 |
| gi|37147896 | ALFCMPGLLT | NMAEGMLMLPP | PQCAEIGDHV | ETA----- | DAD | TPLWSYSI | 215 |
| gi|45826358 | ALFCMPGLLT | NMAEGMLVPP | PQCTEMGDHV | EAD----- | D | MPLWSYSI | 205 |

Consensus  AMF-MP-LL-  NMAEGMLLPP  P-V---H-YD  -DG-----DAD  VSLWSY--  248

Figure 83

| | | | | |
|---|---|---|---|---|
| Lead-CeresClone481915 | MGVPERDPLA | QLSLPPGFRF | YPTDEELLVQ | YLCRKVAGHH | FSLPIIAEVD | 50 |
| gi\|62546187 | MGVPERDPLA | QLSLPPGFRF | YPTDEELLVQ | YLCRKVAGHH | FSLPIIAEVD | 50 |
| gi\|31322582 | MGVREKDPLA | QLSLPPGFRF | YPTDEELLVQ | YLCRKVAGYH | FSLQIIGDID | 50 |
| CeresClone:38344 | MGVREKDPLA | QLSLPPGFRF | YPTDEELLVQ | YLCRKVAGYH | FSLQVIGDID | 50 |
| gi\|7269595 | MGVREKDPLA | QLSLPPGFRF | YPTDEELLVQ | YLCRKVAGYH | FSLQVIGDID | 50 |
| Consensus | MGVREKDPLA | QLSLPPGFRF | YPTDEELLVQ | YLCRKVAGYH | FSLQIIGDID | 50 |

| | | | | |
|---|---|---|---|---|
| Lead-CeresClone481915 | LYKFDPWWLP | ---------- | ------GKA | AFGEKEWYFF | SPRDRKYPNG | 83 |
| gi\|62546187 | LYKFDPWWLP | ---------- | ------GKA | VFGEKEWYFF | SPRDRKYPNG | 83 |
| gi\|31322582 | LYKFDPWDLP | ---------- | ------SKA | LFGEKEWYFF | SPRDRKYPNG | 83 |
| CeresClone:38344 | LYKFDPWDLP | ---------- | ------SKA | LFGEKEWYFF | SPRDRKYPNG | 83 |
| gi\|7269595 | LYKFDPWDLP | SKQTCFTFVG | EYNCNYLGKA | LFGEKEWYFF | SPRDRKYPNG | 100 |
| Consensus | LYKFDPWDLP | ---------- | ------GKA | LFGEKEWYFF | SPRDRKYPNG | 100 |

| | | | | |
|---|---|---|---|---|
| Lead-CeresClone481915 | SRPNRVAGSG | YWKATGTDKI | TTEGRKVGI | KKALVFYVGK | APKGSKTNWI | 133 |
| gi\|62546187 | SRPNRVAGSG | YWKATGTDKI | TTEGRKVGI | KKALVFYLCK | APKGSKTNWI | 133 |
| gi\|31322582 | SRPNRVAGSG | YWKATGTDKI | MSDGHRVGI | KKALVFYAGK | APKGTKTNWI | 133 |
| CeresClone:38344 | SRPNRVAGSG | YWKATGTDKI | TADGRRVGI | KKALVFYAGK | APKGTKTNWI | 133 |
| gi\|7269595 | SRPNRVAGSG | YWKATGTDKI | TADGRRVGI | KKALVFYAGK | APKGTKTNWI | 150 |
| Consensus | SRPNRVAGSG | YWKATGTDKI | IT-DGRRVGI | KKALVFYAGK | APKGTKTNWI | 150 |

| | | | | |
|---|---|---|---|---|
| Lead-CeresClone481915 | MHEYRLLDSS | RKHNLGTAKL | DDWLCRIYK | KNSSAQKVEA | NLLAMECSN- | 182 |
| gi\|62546187 | MHEYRLLDSS | RKHNLGTAKL | DDWLCRIYK | KNSSQKVEA | NFLAMECSN- | 182 |
| gi\|31322582 | MHEYRLIEHS | RSH--GSSKL | DDWLCRIYK | KTSGSQRQAV | ASPVQACLED | 181 |
| CeresClone:38344 | MHEYRLIEHS | RSH--GSSKL | DDWLCRIYK | KTSGSQRQAV | T--PVQACREE | 180 |
| gi\|7269595 | MHEYRLIEHS | RSH--GSSKL | DDWLCRIYK | KTSGSQRQAV | T--PVQACREE | 197 |
| Consensus | MHEYRLIEHS | RSH--GSSKL | DDWLCRIYK | KTSGSQRQAV | --PVQAC-EE | 200 |

Figure 84

```
CeresClone:504165    MTRASTIDFG RRKQSELFGS GPLRPANI-- -RNKFPTYKN GSNGIVIKLA         48
gi|34909052          MTRV-IHDSG EGMQKEAL-- -AMVSSDVNF PKGHFPDYKI GPNNQIIDPE         46
gi|55296828          ---------- --MQKEAL-- -AMVSSDVNF PKGHFPDYKI GPNNQIIDPE         35
Lead-CeresClone534311 MTRL-TRDFG DTMQRDAV-- -PAVSSDVVF ASSRFPNYRI GANNQIIETK        46
gi|23197970          MTRV-TRDFR DSLQRDGV-- -PAVSADVKF ASSRFPNYRI GANDQIFDVK         46

Consensus            MTRV-T-DFG D-MQ-EA--- -PMVSSDV-F -KSRFP-YKI GANNQIID--                50

CeresClone:504165    DGPEMPSLKE AVAKEATDLL DRCQRPSVRE LTMKFEKGEN TATLLSNEAK                98
gi|34909052          ELHEAVPLKE VAKETAQLL  EQRRRLSVRD LKEKFEKGLS GASKLSEEAK                96
gi|55296828          ELHEAVPLKE VAKETAQLL  EQRRRLSVRD LKEKFEKGLS GASKLSEEAK                85
Lead-CeresClone534311 DDPKVLSMKE VVARETAQLL EQHNRLSVRD LASKFEKGLA AAAKLSEEAR               96
gi|23197970          DDPKVMSMKE VVARETAQLM DQQKRLSVRD LAHKFEKGLA AAAKLSEEAK                96

Consensus            D-PEVVSLKE -VAKETAQLL EQRRRLSVRD L--KFEKGL- -A-KLSEEAK               100

CeresClone:504165    WRHAALLERD LLKDLKSVL  ESLRGRVGGK NKDEIEESLS MVDLIAIELS               148
gi|34909052          RREAASLDRQ VLLKKLRDVL DTLKGRVAGR NRDDADEAIS LVEALAVQLT               146
gi|55296828          RREAASLDRQ VLLKKLRDVL DTLKGRVAGR NRDDADEAIS LVEALAVQLT               135
Lead-CeresClone534311 LREAASLEKH VLLKKLRDAL ESLKGRVAGR NKDDVEEAIA MVEALAVQLT                146
gi|23197970          LKEATSLEKH VLLKKLRDAL ESLRGRVAGR NKDDVEEAIA MVEALAVQLT                146

Consensus            -REAASLER- VLLKKLRDVL ESLKGRVAGR NKDDVEEAIS MVEALAVQLT                150

CeresClone:504165    KREDELLRQK TEVTKIADTL KLASTDAKRI IDEERANARL EIESAKASVQ                198
gi|34909052          QREGELIYEK AEVKKLASFL KQATEDARKV AFEERALALA EIEKARTAIA                196
gi|55296828          QREGELIYEK AEVKKLASFL KQATEDARKV AFEERALALA EIEKARTAIA                185
Lead-CeresClone534311 QREGELIQEK AEVKKLANFL KQASEDAKKL VDEERAFARA EIEDARAAVQ                196
gi|23197970          QREGELFIEK AEVKKLASFL KQASEDAKKL VDEERAFARA EIESARAAVQ                196

Consensus            QREGELI-EK AEVKKLASFL KQASEDAKK- VDEERA-ARA EIE-ARAAVQ                200
```

Figure 84 (Continued)

|  | | | | | | |
|---|---|---|---|---|---|---|
| CeresClone:504165 | KIQSALKEQE | IFSQRTGKQD | VDELKEEVQE | ARRVKMLHCP | SKAMDIENEI | 248 |
| gi\|34909052 | IVEKGLQEHD | AASSSREKEE | IEGLRKEVRE | ARRIKMLHQP | SKVMDMEFEL | 246 |
| gi\|55296828 | IVEKGLQEHD | AASSSREKEE | IEGLRKEVRE | ARRIKMLHQP | SKVMDMEFEL | 235 |
| Lead·CeresClone534311 | RVEEALQEHE | RMSQASGKQD | LEQLMREVQE | ARRIKMLHQP | SKVMDMEHEL | 246 |
| gi\|23197970 | RVEEALREHE | QMSRASGKQD | MEDLMKEVQE | ARRIKMLHQP | SRVMDMEYEL | 246 |
| Consensus | RVE-ALQEHE | ---SQ-SGKQD | IE-LRKEVQE | ARRIKMLHQP | SKVMDME-EL | 250 |
| CeresClone:504165 | QMLRDQLAEK | SISDSLRLLKE | LELHRSYGEN | DMPLYELKGL | ETLGSTLRIV | 298 |
| gi\|34909052 | KALRTLIAEK | NQLCNQLMKE | LAMIKRLEED | SSDLYDLEGS | DILGSQFCI- | 296 |
| gi\|55296828 | KALRTLIAEK | NQLCNQLMKE | LAMIKRLEED | SSDLYDLEGS | DILGSQFCI- | 285 |
| Lead·CeresClone534311 | RALRSQLAEK | TRQYLRLQKE | LTRIKKGGEN | VPHLYELEGN | ETLGSYLQIQ | 296 |
| gi\|23197970 | RALRNQLAEK | SKHFLQLQKK | LAMCRKSEEN | ISLVYEIDGT | EALGSCLRVR | 296 |
| Consensus | -ALR-QLAEK | -Q---LQLMKE | LAM-K---EEN | -S-LYELEGS | E-LGS-LRIV | 300 |
| CeresClone:504165 | VHECASVDFS | NSSIQWFRIQ | PEGSKQEIIS | GATKLVYAPE | PHDVGRMQA | 348 |
| gi\|34909052 | PRFDDAPDIS | SCPTQWYRVI | SI-GGNRNLIL | GATKPTYAPE | PFDVGRLLQA | 345 |
| gi\|55296828 | PRFDDAPDIS | SCPTQWYRVI | SI-GGNRNLIL | GATKPTYAPE | PFDVGRLLQA | 334 |
| Lead·CeresClone534311 | PCSDNAPEVS | KCSTQWYRVS | SDGAKKELIS | GATKSVYAPE | PFDVGRILQV | 346 |
| gi\|23197970 | PCSNDAPDLS | KCTIQWYRSS | SDGSKKELIS | GATKSVYAPE | PFDVGRVLHA | 346 |
| Consensus | P---DDAPDIS | SCSIQWYRV- | SDGSK-ELIS | GATK-VYAPE | PFDVGRLLQA | 350 |
| CeresClone:504165 | EVKSGGQISV | AKTAGSIDPA | AGLVEYVETL | VRNPETDYNV | VILQVNGVAQ | 398 |
| gi\|34909052 | EIVLNAEKVT | IQTMGPINPA | AGLEHYVESL | MKRADVEFNV | VVTQMNGNDY | 395 |
| gi\|55296828 | EIVLNAEKVT | IQTMGPINPA | AGLEHYVESL | MKRADVEFNV | VVTQMNGNDY | 384 |
| Lead·CeresClone534311 | DIISESEHVT | LSTACPIDPA | AGLGTYVEAL | VRKHDIEFNV | VVTQMNGSHH | 396 |
| gi\|23197970 | DILYDGHSLS | LSTVGKIDPA | AGLGSYVEAL | VRKHDVDFNV | VVTQMSGEDH | 396 |
| Consensus | EI----AE-VT | -QTMGPIDPA | AGL--YVE-L | VR--DVEFNV | VVTQMNGND- | 400 |

Figure 84 (Continued)

```
CeresClone:504165    AADSVHVLC   GRLRMRLAKE  KTVVAKEFYS  SSMQLCCVRG  GDAAPQALF   448
gi|34909052          SSNSVHAFHI  GKMRIKLRKG  WSTKARESYS  TIMKLCCSRG  GNAAATAVF   445
gi|55296828          SSNSVHAFHI  GKMRIKLRKG  WSTKARESYS  TIMKLCCSRG  GNAAATAVF   434
Lead:CeresClone534311 PIESIHVLHV GKMRIKLCKG  KTTIAKEYYS  SSMQLCCVRG  GNAAAQALF   446
gi|23197970          TSESIHLFHV  GKMRIKLCKG  KTVLAKEYYS  SAMQLCCVRG  GNAAAQALY   446

Consensus            SS-SVHVFHI  GKMRIKL-KG  KTTVAKEYYS  S-MQLCCVRG  GNAAAQA-F   450

CeresClone:504165    WQPRNGLSFV  LAFETTRERN  SALMLARRFA  IDCNILLCGP  GDKTSW----  494
gi|34909052          WQARKGLSYT  LAFETDRDRN  AAIMLARKFA  SNCNITLTGP  GDEVHAGS--  493
gi|55296828          WQARKGLSYT  LAFETDRDRN  AAIMLARKFA  SNCNITLTGP  GDEVHAGS--  482
Lead:CeresClone534311 WQPKQGHSFV LAFESERERN  AAIMLARRFA  FDCNIMLAGP  DDRAPLGT--  494
gi|23197970          WQAKKGVSFV  IAFESERERN  AAIMLARRFA  CDCNVTLAGP  EDRTETGQSP  496

Consensus            WQARKGLSFV  LAFET-RERN  AAIMLARRFA  -DCNITL-GP  GD----GS--  500
```

Figure 85

```
Lead-CeresClone553603  MVPNFLIARL AVSL---THH RSTHIQLGSL LQHKRNAFLL LFNSFTSGTS    47
CeresClone:720248      MVPNFLIARL TASLSSFTHH RSTQTQLGSL LQHKHNAFLF FNSFSSGTS    50

Consensus              MVPNFLIARL --SLSSFTHH RST--QLGSL LQHK-NAFL- -FNSF-SGTS   50

Lead-CeresClone553603  SDSESDGNHQ KGGTFTVSYL INSCGVSPTL ARKLSNKVNL KTPHGPNAVL    97
CeresClone:720248      SDSESDGNYH KGDTFTVSYL INSCGVSPRK AKELSNRINL KTPDGPNAVI   100

Consensus              SDSESDGN-- KG-TFTVSYL INSCGVSP-- A--LSN--NL KTP-GPNAV-  100

Lead-CeresClone553603  DLLNNYGFDK QVAKLVEKH PLVLLADAEN TLLPKLKFLR SIGVSNTDMP   147
CeresClone:720248      DLLNNYGFTK THLAKLVEKH PLVLVADAEN TLLPKLKFFR SIGLSNTDMR   150

Consensus              DLLNNYGF-K ---AKLVEKH PLVL-ADAEN TLLPKLKF-R SIG-SNTDM-  150

Lead-CeresClone553603  KILIANHSLK RSLKKFFIPR YEILRRVLGD DQEVVRAITS SRFGINYGDA   197
CeresClone:720248      KILIANHTLN RSLKKFFIPR YEILRRVLGD DQEVVRAITN SRFGFTYGDT   200

Consensus              KILIANH-L- RSLKKFFIPR YEILRRVLGD DQEVVRAIT- SRFG---YGD-  200

Lead-CeresClone553603  MNLVPNIEVL RQSGVPQASI SFMMIHCGTV AYWKHSRFVE AVNTAKEIGF   247
CeresClone:720248      MNLVPNIEVL RQSGVPQASI TFLMINSATV AYWKHSRFVE AVNTAKEIGL   250

Consensus              MNLVPNIEVL RQSGVPQASI -F-MI---TV AYWKHSRFVE AVNTAKEIG-  250

Lead-CeresClone553603  NPLRTNFIVA EMLLISSKA VWESRFKVYE RWGNREMAL QAFRKFPNVM   297
CeresClone:720248      NPLRTNFIVA VEMLLIRSKA VWESRFEVYE RWGNREMAL QVFRKFPCVM   300

Consensus              NPLRTNFIVA -EMLLI-SKA VWESRF-VYE RWGNREMAL Q-FRKFP-VM  300

Lead-CeresClone553603  RLSEEAFSKK MNFLVNDMGW PSEEIAEYPQ VVAYNLEKRI PRFSVIKIL   347
CeresClone:720248      KLSEETFAKK MSFLVKDMGW LSEDIAEYPQ VIAYNLEKRI PRFSVIKIL   350

Consensus              -LSEE-F-KK M-FLV-DMGW -SE-IAEYPQ V-AYNLEKRI IPRFSVIKIL  350
```

Figure 86

| | | | | | |
|---|---|---|---|---|---|
| CeresClone:1113630 | ------M | NFEETELRLG | ---- | ---- | GSAAKRGFSE | 31 |
| gi\|5139697 | ---MEKKKM | GFEETELRLG | ---- | ---- | VAARKRGFAE | 40 |
| CeresClone:574451 | MEVGLKKENM | GFEETELRLG | IGSS- | -ELGE | VLIRKRGFSE | 39 |
| gi\|114734 | ------M | GFEETELRLG | ---- | -GTEE | VLIRKRGFSE | 30 |
| Lead-CeresClone556734 | ------M | VFEETELRLG | ---- | -GTEE | LGVRKRGFSE | 41 |
| CeresClone:520455 | ------M | VFEETELRLG | LGLCLPGNGT | TATTE-AAAAE | LGVRKRGFSE | 40 |
| CeresClone:1069818 | ---MAGL | GFEETKLRLG | LRLGLPGNGA | APTT-EAAAE | RSSGKRGYAE | 39 |
| gi\|50917147 | ---MAGL | GFDETELRLG | ---LPGGSN | EAEE-AAAAV | RSSGKRGFAE | 33 |

Consensus ------M GFEETELRLG ---LPGNG- ----AAAE VS-RKRGFSE 50

| | | | | | |
|---|---|---|---|---|---|
| CeresClone:1113630 | TAS----- | -VDLKLNLS | SCINDSASDS | PSSVSTEKP- | ---- | 61 |
| gi\|5139697 | VSS---- | SKVDLKLNLS | SKETVGV-GD | DDLVADSNP- | ---- | 75 |
| CeresClone:574451 | TETGHEDESA | TTVDLMLNLS | SKEAATT-AA | AAADPTDKH- | ---- | 77 |
| gi\|114734 | TETGHEDESA | TTVDLMLNLS | SKEAATT-AA | AAADPTDKH- | ---- | 68 |
| Lead-CeresClone556734 | -DET---- | ATVDLMLNLS | PKEAAAA--- | DGADPREKP- | ---- | 73 |
| CeresClone:520455 | TET---- | TSVDLMLNLS | PASVAAPPFE | DGADPRENP- | ---- | 75 |
| CeresClone:1069818 | T---- | -DLVLKLE | PAAPAAVSGE | DDEVADGVA | ---- | 78 |
| gi\|50917147 | T---- | -DLRKLQ | ---- | EGAQEDKEDA | ---- | 72 |

Consensus TET----E--- -TVDLMLNLS -KEAAA---- D-ADP--KP- ---- 100

| | | | | | |
|---|---|---|---|---|---|
| CeresClone:1113630 | ---KENKTTT | AEPPP---AN | DPAKPPA-KA | QVVGWPPVRS | FRKNIV--QR | 102 |
| gi\|5139697 | ---SNKDK | AVLTA---- | DPAKPPA-KA | QVVGWPPVRS | FRKNNML-A-- | 112 |
| CeresClone:574451 | ---KTLPKEK | TLLPA---- | DPAKPPA-KT | QVVGWPPVRS | FRKNMLAVQK | 118 |
| gi\|114734 | ---KTLPKEK | TLLPA---- | DPAKPPA-KT | QVVGWPPVRS | FRKNMLAVQK | 109 |
| Lead-CeresClone556734 | ---KTSPKEK | TLLLP---- | DPAKPPA-KA | QVVGWPPVRS | FRKNMFAAQK | 114 |
| CeresClone:520455 | ---KTSPKDK | NLPLL---- | DPAKPPA-KA | QVVGWPPVRS | FRKNMFAAQK | 116 |
| CeresClone:1069818 | GQLKRSPSQC | SVVITAAQPDA | DPEKPRAPKA | QAVGWPPVRS | FRRNMLAATA | 128 |
| gi\|50917147 | MSMKRSASQS | SVVTA---EP | DPDKPRAPKA | QVVGWPPVRS | FRKNVLAEKC | 119 |

Consensus ---KTSPKEK -LL-A---- DPAKPPA-KA QVVGWPPVRS FRKNMLAAQK 150

Figure 86 (Continued)

| | | | | | |
|---|---|---|---|---|---|
| CeresClone:1113630 | NSNEEEAEKS | IKNA-FVKVS | MDGAPYLRKV | DIKLYKSYQE | LSDALAKMFS | 151 |
| gi\|5139697 | ---------- | ----FVKVS | MDGAPYLRKV | DLKMYKSYKQ | LSDALAAMFC | 147 |
| CeresClone:574451 | SVGEESEKNS | SPNASFVKVS | MDGAPYLRKV | DLKMYKSYRE | LSDSLGKMFS | 168 |
| gi\|114734 | SVGEESEKNS | SPNASFVKVS | MDGAPYLRKV | DLKMYKSYRE | LSDSLGKMFS | 159 |
| Lead-CeresClone556734 | SSGGEESEKS | SPNASFVKVS | MDGAPYLRKV | DLKMYKSYPE | LSDALGKMFS | 164 |
| CeresClone:520455 | SSGGEESEKN | SPNASFVKVS | MDGAPYLRKV | DLKMYKSYPE | LSDALGKMFS | 166 |
| CeresClone:1069818 | ERGGAA---- | -----LVKVS | MDGAPYLRKV | DMGTYKSXQE | LSKALEKMFS | 169 |
| gi\|50917147 | KAAA------ | -----LVKVS | MDGAPYLRKI | DVAMYKSYPE | LSMAFQNMFT | 158 |
| Consensus | SSG-E--E-S | SPNASFVKVS | MDGAPYLRKV | DLKMYKSY-E | LSDALGKMFS | 200 |

| | | | | | |
|---|---|---|---|---|---|
| CeresClone:1113630 | SF-TIEK-CG | SQGMKDFMNE | T------NGS | DYVPTYEDKD | GDWMLVGDVP | 193 |
| gi\|5139697 | SF-TIGN-CG | SQEMKDFMNE | SKLMDLLSGS | DYVPTYEDKD | GDWMLVGDVP | 196 |
| CeresClone:574451 | SF-TFGN-CE | SQGMKDFMNE | SKLNDLLNSS | DYVPTYEDKD | GDWMLVGDVP | 216 |
| gi\|114734 | SF-TIGN-CE | SQGFKDFMNE | SKLMDLLNSS | DYVPTYEDKD | GDWMLVGDVP | 207 |
| Lead-CeresClone556734 | SF-TIGN-CE | SQGFKDFMNE | SKLMDLLNSS | DYVPTYEDRD | GDWMLVGDVP | 212 |
| CeresClone:520455 | SF-TIGN-CE | QAQGMTGMNE | SKLVDLLNGS | DYVPTYEDRD | GDWMLVGDVP | 214 |
| CeresClone:1069818 | SF-TIGNDCS | SHQQLKESNK | LR------DDL | EYVPTYEDKD | GDWMLVGDVP | 218 |
| gi\|50917147 | SF-TIGK-CG | | | | | 201 |
| Consensus | SF-TIGN-CE | SQGMKDFMNE | SKLMDLLNSS | DYVPTYEDKD | GDWMLVGDVP | 250 |

| | | | | |
|---|---|---|---|---|
| CeresClone:1113630 | WEMFVESCKR | LRIMKGSEAI | --GLAPRAVE | KCKNRS | 227 |
| gi\|5139697 | WEMFVESCKR | LRIMKGKEAI | --GLAPRAME | KCKNRS | 230 |
| CeresClone:574451 | WEMFVESCKR | LRIMKGKEAI | GLGLAPRAMA | KCKNRS | 252 |
| gi\|114734 | WEMFVESCKR | LRIMKGKEAI | GLGLAPRAMA | KCKNRS | 243 |
| Lead-CeresClone556734 | WEMFVESCKR | LRIMKGKEAI | --GLAPRAVE | KCKNRS | 246 |
| CeresClone:520455 | WEMFVESCKR | LRIMKGKEAI | --GLAPRAME | KCKNRS | 248 |
| CeresClone:1069818 | WEMFVASCKR | LRIMKGKEAI | --GLAPRAME | KCKSRS | 252 |
| gi\|50917147 | WEMFVESCKR | LRIMKGSEAI | --GLAPRAVE | KCKS-- | 233 |
| Consensus | WEMFVESCKR | LRIMKGKEAI | --GLAPRA-E | KCKNRS | 286 |

Figure 87

```
CeresClone:951040      MSNR-RS--R  QSSSAPRI SD  DQI I DLVTKL  RQI LPEI GQR  RRSDKVSASK   47
CeresClone:966938      MSNR-RS--R  QSSSATRI SD  DQMI DLVGKL  RQFLPEI RER  RRSDKVSASK   48
gi|9294226             MSNR-RS--R  QTSNASRI SD  DQMI DLVSKL  RQFLPEI HER  RRSDKVSASK   47
CeresClone:653656      MSSR-RSRSR  QTSSSRN- TD  DQI NDLVSKL  QQLLPEI RDR  R-SDKVSASK   48
CeresClone:663844      MSSR-RSRSR  QTSSSRNI TD  DQI NDLVSKL  QQLLPEI RDR  R-SDKVSASK   48
Lead-CeresClone560681  MSSR-RS--R  QQSASTRI SD  DQI DLVSKL   RQLVPEI RDR  R-SDKVSASK   46
CeresClone:560948      MSSR-RS--R  QHSGSTRI SD  DQI I ELVSKL RQLVPEI RNR  R-SDKVSASK   46
CeresClone:280170      MSSG-R---  ---- RGRI SD  DEI NELI SKL  QALLPESSRR  RNASRSSASK   41
gi|50912765            MSSR-RS---  --SRGSI SE   EEI NELI SKL  QSLLPNSRRR  G-SSQASTLK   42

Consensus              MSSR-RS--R  QTSSS-RI SD  DQI I DLVSKL  RQLLPEI RDR  R-SDKVSASK   50

CeresClone:951040      VLQETCNYI R  NLNREVDNLS  ERLAQLLESV  DEDSPQAAVI  RSLLM--      92
CeresClone:966938      VLQDTCNYI R  KLHREVDNLS  DRLSQLLDSV  DEDSQEAAVI  RNLLM--      93
gi|9294226             VLQETCNYI R  KLHREVDNLS  DRLSQLLDSV  DEDSPEAAVI  RSLLM--      92
CeresClone:653656      VLQETCNYI R  SLHREVDDLS  ERLSELLATI  D--TAQAAI I  RNLLMQ-      92
CeresClone:663844      VLQETCNYI R  SLHREVGDLS  ERLSELLDTI  D--TAQAAI I  RNLLMQ-      92
Lead-CeresClone560681  VLQETCNYI R  SLHREVDDLS  ERLSQLLATI  DADSPEAAI I  RSLI N--     91
CeresClone:560948      VLQETCNYI R  GLHREVSDLS  ERLSQLLTTI  DKDSAEAG- I  RSLLNQ-      92
CeresClone:280170      LLKETCAYI K  SLHREVDDLS  ERLSGLMSTM  DNDSPQAEI I  RSLLR--      86
gi|50912765            LLKETCNYI K  SLHREVDDLS  DRLSDLMATM  DHNSPGAELI  RSI LRS      88

Consensus              VLQETCNYI R  SLHREVDDLS  ERLS--LL-TV  D DSP-AAI I   RSLLM--      96
```

Figure 89

```
gi|18258              MGNALRFLYG HCCKPTVEDH YQPPHGYGVS TATVGVSALA HDLFHFENTS    50
CeresClone:467480     MGNALRFLYS HCCKPTAAGD SESLGPHGVS SATVGVSTLA HDLFHFDITS    50
Lead-CeresClone6066   MGNALTFLYG KCCKPTTTDD --SLGPHGVS AATVGVSALA HDLFNFEITS    48
gi|4586057            MGNALTFLYG KCCKPTTTDD --SLGPHGVS AATVGVSALA HDLFNFEITS    48

Consensus             MGNAL-FLYG -CCKPTTTDD --SLGPHGVS AATVGVSALA HDLF-FEITS    50 gi|18258              QIPEGLTKYV VSSKKAQINW YKKLSQAWRE AKPPPQTAEQ ATRLILTLK    100
CeresClone:467480     QVPEGLSKHV VSSKKAQANW YRKLVDAWKE AKPPPKTPEE AARLVIQTLR   100
Lead-CeresClone6066   QVPEGLGRYV QSSRKAQANW YRKILEAWKQ AKPPPQTAEE ASRLVTDILK    98
gi|4586057            QVPEGLGRYV QSSRKAQANW YRKILEAWKQ AKPPPQTAEE ASRLVTDILK    98

Consensus             QVPEGL--YV -SS-KAQANW YRK-LEAWK- AKPPPQTAEE ASRLV-D-LK   100 gi|18258              RHQKADVKGL LRFYGLPLSN NPSTEATTVV APPQADQGVK FELHTLPVDV   150
CeresClone:467480     RHQKADVEGL LAFYGLPLPH --TLVQGTTQ PLSSLPDGVQ FEMHTLPVDA   148
Lead-CeresClone6066   RNQKADVEGL LSFYGLPLSH --TLVEVTVE APVSLPEGIL FEFQTLPVDP   146
gi|4586057            RNQKADVEGL LSFYGLPLSH --TLVEVTVE APVSLPEGIL FEFQTLPVDP   146

Consensus             R-QKADVEGL LSFYGLPLSH ---TLVEVTVE APVSLPEG-- FE--TLPVDP   150 gi|18258              KAVADGDTVT VYVNTEDPRE ASNLPKSVKV AAQERAKARA VRDYVKADAL   200
CeresClone:467480     KAVADGDTIT VYVSTTDPRE SAFVPGNVHA AAVRRSEARA RRNFTEADAL   198
Lead-CeresClone6066   KAVADGDTIT VYVSTSEPVV SSSVPREVNL AAVQRAKARE KRNYPKADEL   196
gi|4586057            KAVADGDTIT VYVSTSEPVV SSSLFGDGKC N--------- ---------   177

Consensus             KAVADGDTIT VYVSTS-P-- SSS-P---V-- AAV-RAKARA -RNY-KADAL   200 gi|18258              QKNIVDAGYR VLSGPNNEDI LARKYRIRLR GIDSPESSMP FGKEAKEELI   250
CeresClone:467480     HKQIIDSGYR VIPVQNEEI LAKKYRIRLR GIDAPESAMP YGKEAKTELT   247
Lead-CeresClone6066   HQKIIDSGYR VLNHIENEEV LARKFRIRLR GIDAPESQMP FGKEAQEGLL   245
gi|4586057            --------- --------- -------R  GIDAPESQMP FGKEAQEGLL   198

Consensus             HK-IIDSGYR VL-----NEEI LARKYRIRLR GIDAPES-MP FGKEA-E-LL   250
```

Figure 89 (Continued)

```
gi|18258            KLVGKCLTV  HIYEEDRYGR  SVGDIYCNGQ  FIQEKMLKKG  LAWHYTAYDK  300
CeresClone:467480   KIVQGKPLRI  LVYEEDRYGR  SVGDIYXXGI  FVQEMMLKKG  LAWHYVAYDK  297
Lead-CeresClone6066 KIVGRKSLKV  LVYGEDQYGR  CVGDLYCNGI  FVQEAMLKKG  LAWHYLAYDK  295
gi|4586057          KIVGRKSLKV  LVYGEDQYGR  CVGDLYCNGI  FVQEAMLKKG  LAWHYLAYDK  248

Consensus           KIVG-KSLKV  LVY-ED-YGR  -VGD-YCNGI  FVQEAMLKKG  LAWHYLAYDK  300 gi|18258            RPQLSK---W  EEKARAARVG  LWASSNPEKP  WEWRKNKRNG  K  338
CeresClone:467480   RPELET---W  EKQARAKRVG  LWASKNPEKP  WEWRKDRREA  A  335
Lead-CeresClone6066 RPVLAK---W  EKEARQKRIG  LWASSNPEKP  WDWRKNNRRE  -  332
gi|4586057          RPVLAKARLW  EKEARQKRIG  LWASSNPEKP  WDWRKNNRRE  -  288

Consensus           RP-LAK---W  EKEAR-KR-G  LWASSNPEKP  W-WRKN-RRE  -  341
```

Figure 90

| | | | | | | |
|---|---|---|---|---|---|---|
| Lead-CeresClone6568 | MNSIFSIDDF | SDPFWETPPL | PLNPDSSKPV | TA-------- | GGVAGGGGGG | 32 |
| gi\|7489532 | MERVFSVEEI | SDPFWVPPPP | PQSAAAAQQQ | GGGVASGGG | -------- | 50 |
| gi\|1869928 | MERVFSVEEI | PDPFWGQPSP | RQR--GRRPP | EG------- | -------- | 30 |
| Consensus | MERVFSVEEI | SDPFW--PPP | PQ-------P | --G------ | -------- | 50 |

| | | | | | | |
|---|---|---|---|---|---|---|
| Lead-CeresClone6568 | DEVSQSQPEW | TFEMFLEELS | SSAVSSEPLG | NNNNAIVGVS | SAQSLPSVSG | 82 |
| gi\|7489532 | NAMNRCPSEW | YFQKFLEEAV | LDSPVPNP-- | -------- | ----SPRAE | 83 |
| gi\|1869928 | -AMNRCPSEW | YFQKFLEEAV | LDSPAADP-- | -------- | ----SPMSG | 62 |
| Consensus | -AMNRCPSEW | YFQKFLEEAV | LDSP----P- | -------- | ----SP-SG | 100 |

| | | | | | | |
|---|---|---|---|---|---|---|
| Lead-CeresClone6568 | QNDFEDDSRF | RDRDSGNL-- | -DCAAPMTTK | TVIVDSDDYR | RVLKNKLETE | 129 |
| gi\|7489532 | AGGIRGAGGV | VPVDVKQPQL | SAAAAAAATT | SAVVDPVEYN | AMLKQKLEKD | 133 |
| gi\|1869928 | ASG-RGQAAC | RPRGV----- | ---AGTAT-- | GPAVDPVEYN | AMLKQKLEKD | 101 |
| Consensus | A-G-RG---- | RPRDV----- | ----AAA-TT | --VDPVEYN | AMLKQLEKD | 150 |

| | | | | | | |
|---|---|---|---|---|---|---|
| Lead-CeresClone6568 | CATVVSLRV- | GSVKPEDSTS | SPET------ | HIGAPISI-- | QLQPVQSSPL | 162 |
| gi\|7489532 | LAAVAMWRAS | GTVPPERPGA | GSSLLNADVS | SAVVDPDDME | NATPVQN--M | 181 |
| gi\|1869928 | LAAVAMWRAS | CAMPPERFAA | SPSCPNADGQ | HIGTINPL-- | NVMPLQNK-L | 150 |
| Consensus | LAAVAMWRAS | G-VPPER--A | SPS--NAD-- | HIG------ | N--PVQN--L | 200 |

| | | | | | | |
|---|---|---|---|---|---|---|
| Lead-CeresClone6568 | TQGELGVTSS | LPAEVKKTGV | SMKQVTSGSS | REYSDDEDLD | EENETTGSLK | 212 |
| gi\|7489532 | LSGPSGGSG- | --SQLVQNVDV | LVKQATSSSS | REQSDDDDME | GEAETTGTAR | 229 |
| gi\|1869928 | AGGASGVSG- | -PHLVQNADA | LVKQAASSSS | REQSEDDDME | GEDETTGNGV | 198 |
| Consensus | --G-SGVSG- | -P-LVQN-DV | LVKQATSSSS | REQSDDDDME | GE-ETTG--- | 250 |

| | | | | | | |
|---|---|---|---|---|---|---|
| Lead-CeresClone6568 | PEDMKSIRRM | LSNRESARRS | RIRIRKQEQISD | LETQVNDLKG | EHSSLLKQLS | 262 |
| gi\|7489532 | PADQRLQRRK | QSNRESARRS | RSRKAAHLNE | LEAQVSQLRV | ENSSLLRRLA | 279 |
| gi\|1869928 | PTDQRLRRRK | QSNRESARRS | RSRKAAHLNE | LEAQVSQLRV | ENSSLLRRLA | 248 |
| Consensus | P-DQRL-RRK | QSNRESARRS | RSRKAAHLNE | LEAQVSQLRV | ENSSLLRRLA | 300 |

Figure 90 (Continued)

```
Lead-CeresClone6568  NMNHKYDEAA  VGNRILKADI  ETLRAKVKMA  EETVKRVTGM  NPMLLGRSSG  312
gi|7489532           DVNQKYNDAA  VDNRVLKADV  ETLRAKVKMA  EDSVKRVTGM  NALF--PAAS  327
gi|1869928           DVNQKYNGAA  VDNRVLKADV  ETLRAKVKMA  EDSVKRVTGM  SALF--PAGS  296

Consensus            DVNQKYN-AA  VDNRVLKADV  ETLRAKVKMA  EDSVKRVTGM  NALF---PA-S  350

Lead-CeresClone6568  HNNNNRMPIT  GNNRMDSSSI  IPAYQPHSNL  NHMSNQNIGL  PTILPPRLGN  362
gi|7489532           DMSSLSMPFN  SSPSEATSDA  AVPIQDDPNN  YFATNNDIGG  NNNYMPDIPS  377
gi|1869928           DMSSLSMPFT  GSPSEATSDA  AFPI--DDLSA  YFST-SEAGG  NNGYMPEMAS  343

Consensus            DMSSLSMPFT  GSPSEATSDA  A-P-QDD-N-  YF-TN--IGG  NN--YMP----S  400

Lead-CeresClone6568  NFAAPPSQIS  SPLQRIRNGQ  NHHVTPSANP  YGWNTEPQND  SAWPKKCVD   411
gi|7489532           SAQEDEDFVN  GALAAGKIGR  TASLQRVASL  EHLQKRMCGG  PASSGSTS-   425
gi|1869928           SAQEDDNFLN  ETMDTSKMGR  PDSLHRVASL  EHLQKRMCGG  PASSGSTS-   391

Consensus            SAQED--F-N  ---L----K-GR  --SL-RVASL  EHLQKRMCGG  PASSGSTS-   449
```

Figure 91

```
Lead-CeresClone7201    ----MAGMLPG VECARRRRFH GGAPPIESSN TASVAAAAGH VWTRRPSFSL    47
CeresClone:40916       ----MAGMLPG VECARRRRFH GGAPPIESSN TASVAAAAGH VWTRRPSFSL    47
CeresClone:879445      ----MAGMLPG VECARRRRMW QGG------G AGADQAAAG- --TRRLSFCL   38
CeresClone:294406      MVLMAGMLPG VECARRRRVR QGG------AG MGAEAAGGT -GRRSSFCL    43

Consensus              ----MAGMLPG VECARRRR-H -G-PPIESS- T----AAAGH VWTRRPSF-L    50

Lead-CeresClone7201    YTTNHE-SHQ AHVSFSERSV RNKSYGEDND EKLDGAAKEA KQRLNKRLRI    96
CeresClone:40916       YTTNHE-SHQ AHVSFSERSV RNKSYGEDND EKLDGAAKEA KQRLNKRLRI    96
CeresClone:879445      YAAGHGAAHA VGTGNSGNKQ RSGAM---DG WALDSNAREA KERLDQKLKS   85
CeresClone:294406      YAAGHG---- --GAGNSGK- RSCGVVHGXG WTLDSNAREA KERLDQKLRT   86

Consensus              Y----H-SHQ A-V---S-RSV R--S-GEDN- -KLD--A-EA K-RL----LR-   100

Lead-CeresClone7201    -------P-- RTRQNG--KD -KGNKLEQGK GKPLGDLPTE VVGLKKS---   132
CeresClone:40916       -------P-- RTSSGKMVKT -KGINMSKER VNLSGTYRPR WVGLKKS---   134
CeresClone:879445      KSTGPDTVIK RHHSTGSIKL SRANGSGGGG GGGGSSAAV ATGVQREVYS   135
CeresClone:294406      K----REAAIK RHHSTGSIKL -GVPHRSAGA DERGESSAPA MAGVQREVYS   132

Consensus              -------P-- R-HSTGSIKL -KGN--S-G- G--GGSSAP- -VG-----VYS   150

Lead-CeresClone7201    -RG----RLME WFKRR---VRE QQDCAICLDR FKKGETLVHL PCAHKFHSIC    176
CeresClone:40916       -RG----RLME WFKRR---VRE QQDCAICLDR FKKGETLVHL PCAHKFHSIC   178
CeresClone:879445      KKGVMRRLMR WSRLRWEAAE QAECAVCLEE FAAGDVLAHL PCGHRFHWGC   185
CeresClone:294406      KKGVMRRLMR WSRPRWAAAE QAECAVCLDE FRAGDVLAHL RCGHRFHWAC   182

Consensus              K-GVMRRLM- W--RRW---E Q---CA-CLD- FK-G--L-HL PC-H-FH-IC   200

Lead-CeresClone7201    LLPWLDTNV- ---YCPYCRT DIWN------ ---------- ----------    196
CeresClone:40916       LLPWLDTNV- ---YCPYCRT DIWN------ ---------- ----------   198
CeresClone:879445      ALPWLEGAAA ASHSCPFCRA AVDAGAHAAS DGA------- ----------   215
CeresClone:294406      ALPWLEGTS- ---RCPFCRA AVDAGAGAGA ---------- ----------   211

Consensus              -LPWL--N-- ---YCP-CR- ----GA-A-- ---------- ----------   233
```

Figure 92

| | | | | | | |
|---|---|---|---|---|---|---|
| Lead-CeresClone7805 | MADTPSSPAG | D-GGE----- | SGGSVREQDR | YLPIANISRI | MKKALPPNGK | 44 |
| CeresClone:1045975 | MSDAPPSPTH | ESGGEQSPRG | SSSGAREQDR | YLPIANISRI | MKKALPPNGK | 50 |
| Consensus | M-D-P-SP-- | -SGGEQSPRG | S----REQDR | YLPIANISRI | MKKALPPNGK | 50 |
| | | | | | | |
| Lead-CeresClone7805 | IGKDAKDTVQ | ECVSEFISFI | TSEASDKCQK | EKRKTVNGDD | LLWAMATLGF | 94 |
| CeresClone:1045975 | AKDAKDTMQ | ECVSEFISFI | TSEASEKCQK | EKRKTINGDD | LLWAMATLGF | 100 |
| Consensus | I--KDAKDT-Q | ECVSEFISFI | TSEAS-KCQK | EKRKT-NGDD | LLWAMATLGF | 100 |
| | | | | | | |
| Lead-CeresClone7805 | EDYLEPLKIY | LARYRELEGD | NKGSGKSGDG | SNRDAGGGVS | GEEMPSW | 141 |
| CeresClone:1045975 | EDYIEPLKVY | LARYREAEGD | TKGSARSGDG | SA-------- | -------- | 132 |
| Consensus | EDY-EPLK-Y | LARYRE-EGD | -KGS--SGDG | S-RDAGGGVS | GEEMPSW | 147 |

Figure 94

```
Lead-CeresClone955048   MSAALSSSLY  ISPKKPSSPQ  LSQ------STK  PTTIKTTLHT  HPLFSVADQA   46
gi|3128213              MSAALSSSLY  SPKKPSCPQ   QSQSTFLSTK   PTTIKTNLHS  HPLFTVADQT   50
Consensus               MSAALSSSLY  ISPKKPS-PQ  -SQSTFLSTK   PTTIKT-LH-  HPLF-VADQ-   50

Lead-CeresClone955048   VTLQMKEKIL  CLELMGIDSG   KALSLNPFLR  SASLDSVEAV   LNFLQSKGIY   96
gi|3128213              VTLQMKEKIL  CLELMGIDSG   KALSLNPCLC  SAPLDSIQSV   LHFLQSKGIY  100
Consensus               VTLQMKEKIL  CLELMGIDSG   KALSLNP-L-  SA-LDS---V   L-FLQSKGIY  100

Lead-CeresClone955048   PNDLPRILGM  CPKILTSDIR   TELNPVFTFL  SSDLHVPDNA   FRRVVKKCPR  146
gi|3128213              PNDLPRILGM  CPKILTSDVR   TELYPVFMFL  SNDLHVPENA   FRRVIKKCPR  150
Consensus               PNDLPRILGM  CPKILTSD-R   TEL-PVF-FL  S-DLHVP-NA   FRRV-KKCPR  150

Lead-CeresClone955048   LLISTVEDQL  KPALFYLQRL   GFKDLDALAY  QDPVLLVSSV   EXTLIPKLRF  196
gi|3128213              LLISSVEDQL  KPALFYLQRL   GLKDLEALAY  QDPILLVSSV   EHTLIPKLRF  200
Consensus               LLIS-VEDQL  KPALFYLQRL   G-KDL-ALAY  QDP-LLVSSV   EHTLIPKLRF  200

Lead-CeresClone955048   LESIGFSRSE  AIGMILRCPA   LFTFSIENNF  KPKLDYFMCE   KGKLENLKE   246
gi|3128213              LESIGFSRPE  AIGMILRCPA   LFTFSIENNF  KPKLDYFMSE   KGKLENLKE   250
Consensus               LESIGFSR-E  AIGMILRCPA   LFTFSIENNF  KPKLDYFM-E   IKGKLENLKE  250

Lead-CeresClone955048   FPQYFAFSLE  KRIKPRHLKX   MERGLELPLA  LMLKSXDEEF   EQLLLQTEPX  296
gi|3128213              FPQYFAFSLE  KRIKPRHLES   MERGLELPLS  LMLKSTDEEF   EQLL--TNPS  298
Consensus               FPQYFAFSLE  KRIKPRHL-S   MERGLELPL-  LMLKSTDEEF   EQLLLQT-PS  300

Lead-CeresClone955048   PVVNV      301
gi|3128213              SVANV      303
Consensus               -V-NV      305
```

Figure 95

``` gi|4678318          MAEVLRPEML DISNDTSSLA SPKLLHVLAV DDSMVDRKFI ERLLRVSSCK      50
Lead-CeresClone968026 MAEVMLPMKM EMANDPSKFT SPDLLHVLAV DDSHVDRKFI ERLLKVSSCK    50
gi|28466913         MAEVMLPRKM EINHSSKFG  SPDPLHVLAV DDSHVDRKFI ERLLRVSSCK      50

Consensus           MAEVMLP-KM EI-ND-SKF- SPDLLHVLAV DDSHVDRKFI ERLLRVSSCK       50 gi|4678318          VTVVDSATRA LQYLGLDGEN NSSVGFEDLK NLI MTDYSM PGMTGYELLK      100
Lead-CeresClone968026 VTVVDSATRA LQYLGLD-VN EKPIGCKDLK VNLI MTDYSM PGMTGYELLK   99
gi|28466913         VTVVDSATRA LQYLGLD-VE EKSVGFEDLK VNLI MTDYSM PGMTGYELLK      99

Consensus           VTVVDSATRA LQYLGLD-VN EKSVGFEDLK VNLI MTDYSM PGMTGYELLK        100 gi|4678318          KIKESSAFRE PVVI MSSEN LPRI DRCLE EGAEDFLLKP VKLADVKRLR        150
Lead-CeresClone968026 KIKESSAFRD VPVVVMSSEN LSRI DRCLE EGAEDFLLKP VKLSDVRRIR    149
gi|28466913         KIKESSAFRE VPVVI MSSEN LPRI DRCLE EGAEDFLLKP VKLSDVKRLR      149

Consensus           KIKESSAFRE VPVVI MSSEN ILPRI DRCLE EGAEDFLLKP VKLSDVKRLR       150 gi|4678318          DSLMKAEERA FKNI MHKREL EANDIYS--- ----QLKRAK                  184
Lead-CeresClone968026 DSLIKVEDLS FTKSI NKREL ETENVYSLDS SVPLQLKRTK                190
gi|28466913         DSLMKVEDLS FTKSIQKREL ETENVYPVHS ----QLKRAK                   186

Consensus           DSLMKVEDLS FTKSI-KREL ETENVYS--S ----QLKRAK                      191
```

Figure 96

```
CeresClone:516604      MPRPK----RK AAPPITSSDV DSSLRTEPKK STTKQFDRID KLFESYANKS   47
CeresClone:1403244     MRRTS----KK SSSTATAS- ---AGPTK AVSKEVERID QFFYTYADNS    41
CeresClone:971321      MRRSSAASKK KFDSLTSSTT D-LFRSGPSK ATSKEMDRID HLFNQYANTS    49
Lead·CeresClone99075   MRRSS-SKKK SGQSTESVTT D-LFRSASSK ASNKEMDRID HLFNQYANKS    48
gi|25518040            MRRSS-SKKK SGQSTESVTT D-LFRSASSK ASNKEMDRID HLFNQYANKS    48

Consensus              MRRSS-S-KK S---ST-SATT D-LFRS-PSK A--KLMDRID HLFNQYANKS   50

CeresClone:516604      LGLIDPDGIE ALCKDVHVDH TDVRMLILAW KLKAEKQGYF SKDEWQKGLK   97
CeresClone:1403244     SIGMIDPEGIE TLCSHLEVPH TDVRILMLAW KMGCDKQGYF TLDEWRTGLK   91
CeresClone:971321      SNLIDPEGIE ELCSNLEVPH TDIRILMLAW KMKAEKQGYF TQEEWRRGLK   99
Lead·CeresClone99075   SSLIDPEGIE ELCSNLEVSH TDIRILMLAW KMKAEKQGYF THEEWRRGLK   98
gi|25518040            SSLIDPEGIE ELCSNLEVSH TDIRILMLAW KMKAEKQGYF THEEWRRGLK   98

Consensus              SSLIDPEGIE ELCSNLEV-H TDIRILMLAW KMKAEKQGYF T-EEWRRGLK  100

CeresClone:516604      CLGADTLPKL RKAINGLKKE V--------- -TVPECFEDF YSYAFQYCLT  137
CeresClone:1403244     ALRADSISKL KKAFPELVQE V--------- -TRPSNFQDF YLYAFRYCLT  131
CeresClone:971321      ALRADTLSKL KKALPELEKE V--------- -RRQSNFADF YAYAFRYCLT  139
Lead·CeresClone99075   ALRADTINKL KKALPELEKE V--------- -RRPSNFADF YAYAFCYCLT  138
gi|25518040            ALRADTINKL KKALPELEKE TESFLFLSLE GQRPSNFADF YAYAFCYCLT  148

Consensus              ALRADTI-KL KKALPELEKE V--------- -RRPSNFADF YAYAFRYCLT  150

CeresClone:516604      EEKQRSVDIE RSEFPTQVNL LTEYLKIQND YRALNIDHWR             187
CeresClone:1403244     EDKKKCEIP- GLQFRPQVDK LNNYLMYQND YKVITMDQWM             181
CeresClone:971321      EEKQKSIDIE GSTFRAQVDY FVEYLKIQND YKVINMDQWM             189
Lead·CeresClone99075   EEKQKSIDIE GSTFRAQVDY FVEYLKIQND YKVINMDQWM             188
gi|25518040            EEKQKSIDIE GSTFRAQVDY FVEYLKIQND YKVINMDQWM             198

Consensus              EEKQKSIDIE GSTFRAQVDY FVEYLKIQND YKVINMDQWM             200
```

Figure 96 (Continued)

| | | | | | |
|---|---|---|---|---|---|
| CeresClone:516604 | N FYRF F KEVS | L T DL RSYDS S | Q AWPVI LDNF | VDWLKE KE E K | 228 |
| CeresClone:1403244 | GF I RFCNEI N | F PSL DNYDSD | LAWPLI LDNF | VEWLRE N KS — | 220 |
| CeresClone:971321 | GFYRFCNQI S | F PEMT E YNPE | LAWPLVLDSF | VEWI S EKQA — | 228 |
| Lead-CeresClone99075 | GL YRFCNEI S | F PDMG NYNPE | LAWPLI LDNF | VEWI QEKQA — | 227 |
| gi|25518040 | GL YRFCNEI S | F PDMG DYNPE | LAWPLI LDNF | VEWI QEKQA — | 237 |
| | | | | | |
| Consensus | GFYRFCNEI S | FPDM-NYNPE | LAWPLI LDNF | VEWI QEKQA — | 241 |

Figure 97

| | | | | | |
|---|---|---|---|---|---|
| gi\|50510178 | MNEKASVSKE | LNAKHKKI LE | GLLRLPENRE | CADCKSKGPR | WASVNLGI FI | 50 |
| CeresClone:282105 | MNEKASVSKE | LNAKHKKI LE | GLLRHPENRE | CADCKSKGPR | WASVNLGI FI | 50 |
| CeresClone:575526 | MNEKASVSKE | LNARHKKI LE | CLLRLPENRE | CADCKSKGPR | WASVNLGI FV | 50 |
| CeresClone:478849 | MNSKANVSKE | LNAKHKKI LE | GLLKLPENRG | CADCKAKGPR | WASVNLGI FI | 50 |
| Lead-CeresClone99519 | MNEKANVSKE | LNARHRKI LE | GLLKHPENRE | CADCKTKGPR | WASVNLGI FI | 50 |
| Consensus | MNEKANVSKE | LNAKHKKI LE | GLLRLPENRE | CADCKSKGPR | WASVNLGI FI | 50 |
| | | | | | | |
| gi\|50510178 | CMQCSGI HRS | LGVHI SKVRS | ATLDTWLPEQ | VAFI QSMGNE | KSNSYWEAEL | 100 |
| CeresClone:282105 | CMTCSGI HRS | LGVHI SKVRS | ATLDTWLPEQ | VAFI QSMGNE | KANSYWEAEL | 100 |
| CeresClone:575526 | CMQCSGI HRS | LGVHI SKVRS | ATLDTWLPEQ | VAFI QSMGNE | KANGYWEAEL | 100 |
| CeresClone:478849 | CMQCSGI HRS | LGVHI SKVRS | ATLDTWLPDQ | VAFI QSMGNE | KANSFWEAEL | 100 |
| Lead-CeresClone99519 | CMQCSGI HRS | LGVHI SKVRS | ATLDTWLPEQ | VAFI QSMGND | KANSYWEAEL | 100 |
| Consensus | CMQCSGI HRS | LGVHI SKVRS | ATLDTWLPEQ | VAFI QSMGNE | KANSYWEAEL | 100 |
| | | | | | | |
| gi\|50510178 | PPNYDRVGI E | NFI RAKYEDK | RWI PRNGSSR | PSSGARDEKS | SESQTS--VN | 148 |
| CeresClone:282105 | PPNYDRVGI E | NFI RAKYEDK | RWVPRNGTSK | SSSVRDEKS | QESPAS--AN | 148 |
| CeresClone:575526 | PPNYDRVGI E | NFI RAKYEDK | RWI PRNGTSK | LPSSARDEKS | SESQAS-HAN | 149 |
| CeresClone:478849 | PPNYDRVGI E | NFI RAKYDEK | RWI PRDGNSK | TPSGLREEKS | PSHWQR-PVE | 149 |
| Lead-CeresClone99519 | PPNYDRVGI E | NFI RAKYEEK | RWVSRGEKAR | SPPRVEQERR | KSVETSGPGY | 150 |
| Consensus | PPNYDRVGI E | NFI RAKYEDK | RWI PRNG-SK | SPS-VRDEKS | -ESQ-S---N | 150 |
| | | | | | | |
| gi\|50510178 | RGGHNQRSS-- | -FEQHRTSPA | AVSKI APVVS | RT PT QAPHQ- | PKAQP-SVPK | 194 |
| CeresClone:282105 | RSGHGHRSS-- | -FEQNRASPA | LPSKVAHAAS | RI SSQASPQP | PKVET -PVPK | 195 |
| CeresClone:575526 | RGGHAQKPS-- | -FEQHRVSPA | ATKRTVPVAS | RMHTQASPQ- | PKAEL -PVPK | 195 |
| CeresClone:478849 | RSGYAAVSEN | KFEERKKI QP | S---NAI SIT | RI NVPAPPRA | SEQVT -PI TK | 195 |
| Lead-CeresClone99519 | EHGHSSSPVN | LFEERKT I PA | SRTRNNVAAT | RI NLPVPPQG | PSQVI KPQQK | 200 |
| Consensus | R-GH--RSS- | -FEQHR-SPA | --S--A-AAS | RI NTQAPPQ- | PK-E---PVPK | 200 |

Figure 97 (Continued)

| | | | | | |
|---|---|---|---|---|---|
| gi\|50510178 | V-SPPQPEKS | PP--NATPPK | VERPSVAP-- | ---------- | ----KVDYATDLFN | 231 |
| CeresClone:282105 | VVLPPQSQKS | PAKVDATPPK | VEKPSVTP-- | ---------- | ----KVDYATDLFN | 235 |
| CeresClone:575526 | VASPPQPAKS | PAKVDVTPPK | VHQPSVAP-- | ---------- | ----KVDYADDLFN | 235 |
| CeresClone:478849 | ----PQHVEK | VEPMAPQPPA | SQPQAETSKQ | ATDTVQNIPP | ----KVDYATDLFN | 241 |
| Lead-CeresClone99519 | MESAATPVER | EKQAVNVAPA | SD-------- | ---------- | ----KVDFATDLFN | 234 |

Consensus   V-SPPQP-KS  P-KVD-TPPK  VE-PSV-P--  ----------  --PP KVDYATDLFN  250

| | | | | | |
|---|---|---|---|---|---|
| gi\|50510178 | MLSMDGTTEK | EAESS----- | NDDSAWEGFQ | SAEP PSSDK | KDSAKPVESK | 277 |
| CeresClone:282105 | MLSMDGTTEK | ESASS-----S | NDDNGWDGFQ | SAQPVPSSEK | KDSAKPAESK | 281 |
| CeresClone:575526 | MLSMDGTTEK | EPVSS-----S | NDDNAWDGFQ | SAEPAPNSEK | KDTAKPVESK | 281 |
| CeresClone:478849 | MLSMDGPNEN | GSEAA--GIT | TDDNHWAGFQ | SAAEVSTAEK | TSPLKAADST | 289 |
| Lead-CeresClone99519 | MLSMDDSTTN | TSEATPGDTP | ADDNSWAGFQ | SAGSGQTAEK | IVTAKPAESS | 284 |

Consensus   MLSMDGTTEK  ESESS-----S  NDDNAWDGFQ  SAEPVP-SEK  KD-AKPAESK  300

| | | | | | |
|---|---|---|---|---|---|
| gi\|50510178 | --PQSTSGIE | DLFKDSPAVT | VSSAPAAPQV | NVKNDI MSLF | EKSMVSPYA | 325 |
| CeresClone:282105 | TQSTSGME | DLFKDSPAVP | LSSAPAVSQV | NAKNDI MSLF | EKSNMVSPFA | 329 |
| CeresClone:575526 | --AQSTSGIE | DLFKDSPAVA | ASSAPVASKS | NPQTDI MSLF | EKSNMVSPFA | 329 |
| CeresClone:478849 | --PVSASGIE | DLFKDLSPVT | PSLTPEKPQK | DVKNDI MRLF | EKGNI VSPFS | 337 |
| Lead-CeresClone99519 | SPPASSSDFE | DLFKDTPNLT | TQQAP----K | DVKGDI MSLF | EKTNI VSPFA | 330 |

Consensus   --PQSTSGIE  DLFKDSPAVT  -SSAP---Q-  NVKNDI MSLF  EKSNMVSPFA  350

| | | | | | |
|---|---|---|---|---|---|
| gi\|50510178 | VQQQQLAFMT | PQQLALLSQQ | QALLMAAL-- | KAGNAPQM-- | ----PGN | 365 |
| CeresClone:282105 | AHQQQLALMS | ---------QQ | QALLMAAL-- | KAGNAPQM-- | ---MI PGT | 362 |
| CeresClone:575526 | LHQQQLAFMT | ---------QQ | QALLMAAL-- | KSGNAPQMVP | GNAPQMVPGN | 369 |
| CeresClone:478849 | MHQQQLGMLA | ---------HQ | QSLLMAAAAK | STGGDPRY-- | ----PAN | 370 |
| Lead-CeresClone99519 | MHQQQVAMLA | ---------QQ | QALYMAAA-K | AAGGTPNG-- | ----VNQ | 362 |

Consensus   MHQQQLAMM-  ----------QQ  QALLMAAL--  KAGNAPQM--  ----I PGN  400

Figure 97 (Continued)

| | | | | | | |
|---|---|---|---|---|---|---|
| gi\|50510178 | ASLLNGNGSN | PANGGLPSQS | WTNL-AYQNP | GLA-PVAA-Q | NGATKVANN- | 411 |
| CeresClone:282105 | ANQLNA---- | --NGTLPFQN | WTNL--YQNP | GST-PAAA-Q | NGATKVANN- | 401 |
| CeresClone:575526 | ASVLNANGSN | APNGSLPSHS | MPNL--GYQNP | ASI-PAAAPQ | NGVAKAGNN- | 416 |
| CeresClone:478849 | IQQPRP---- | --PNVPLQS | MPAT--GYSTP | GVM-PMGG-Q | GDLQKLMQSG | 410 |
| Lead-CeresClone99519 | QAIANA---- | --LNVASAN | WSNPGGYQIP | GMTNPVGG-Q | ADLQKLMQNM | 404 |
| Consensus | AS-LNA---- | --NG-LPSQN | WTNL-GYQNP | G----PVAA-Q | NGL-K--NN- | 450 |

| | | | | | | |
|---|---|---|---|---|---|---|
| gi\|50510178 | -------N | QEFSFGNFNF | STPGAYNTSS | -SVPANG-AA | SAAANKSTS- | 449 |
| CeresClone:282105 | -------N | QDFSSGTFGF | GTPGVYNSP | -TVPANGATT | AGAINNGTAS | 441 |
| CeresClone:575526 | -------N | QDFFSGNFGF | GSPG------ | --KPANG-AT | TAGANKSAST | 448 |
| CeresClone:478849 | PRSMT---P | AHFAGSSVQY | PPSSFYGMGQ | VAPPVNGMMT | TMGVNKPQSG | 456 |
| Lead-CeresClone99519 | NMNANMNTRP | AQPQENTLQY | PSSSFYTMGQ | ANQVNG-MT | PNSTGKPQSS | 452 |
| Consensus | -------N | Q-FS-G-F-F | ---PG-Y-M-- | ---PANG--T | --A-NK---SS | 500 |

| | | | | | |
|---|---|---|---|---|---|
| gi\|50510178 | ------ | PTSSSL | PSQSGKEYDF | R | | 476 |
| CeresClone:282105 | --TA | SSTL | PSQSGKDYDF | R | | 468 |
| CeresClone:575526 | ------ | PTSSTL | PSQSGKEYDF | R | | 475 |
| CeresClone:478849 | A--- | PAVSS | PTQSAKDYDF | Q | | 484 |
| Lead-CeresClone99519 | SATQ | PTSTIP | SSQSGKDFDF | H | | 483 |
| Consensus | ------ | PTSSTL | PSQSGKDYDF | R | | 531 |

Figure 98

```
Lead-CeresClone:3774    MGAKAKKALK  KNMKKVAASA  ---SSSQLPL  PQNPKPSADF  LPLEGGPARK   47
CeresClone:1035997      MGAKAKKALK  KNMKKITASA  AASSSSQLAA  PQNTKPSADF  LPLEGGPARK   50

Consensus               MGAKAKKALK  KNMKK--ASA  AASSSSQL--  PQN-KPSADF  LPLEGGPARK   50

Lead-CeresClone:3774    APVTTPPLQN  KATVLYIGRI  PHGFYETEIE  AFFSQFGTVK  RVRVARNKKT   97
CeresClone:1035997      AP--ATKTIEN KATVLYIGRL  PHGFYETEIE  AFFTQFGTVK  RVRVARNKKT   99

Consensus               APV-T----N  KATVLYIGR-  PHGFYETEIE  AFF-QFGTVK  RVRVARNKKT  100

Lead-CeresClone:3774    GKSKHFGFIQ  FEDPEVAEIA  AGAMNDYLLM  EHMLKVHVIE  PEC         140
CeresClone:1035997      GKSKHFGFIQ  FEDPEVAEIA  AGAMNDYLLL  E---------  ---         130

Consensus               GKSKHFGFIQ  FEDPEVAEIA  AGAMNDYLL-  EHMLKVHVIE  PEC         143
```

Figure 100 (Continued)

```
CeresClone:1771837    AIGNGRYYTL VIANERRWS RLRNRLKVVA DSFKISDLTA  232
Lead-CeresClone-16403 AVGNNRYYTL IVGANERRWR KVKKQLQVVA DSLKILQI--  238
CeresClone:611156     AIGNGRFYTL VGANERRWK RFRDQLKVVA DSFRLLDI--  234
CeresGdna:1464944     VIANGRFYTL IVGANERRWR RYRSQLKVVA DSFKVLDI--  232
CeresClone:1807796    AIGNGRYYTL VVGALERRWR RLRNKLKVVA DSFKVLDI--  235

Consensus             AIGNGRYYTL IVGANERRWR RLRNQLKVVA DSFK-LDI--  240
```

Figure 101

```
Lead-CeresClone-16450   MFI KVKLPWD----VTIPAEDMD-TGLMLQRAIV RLLEAFSKE KATKDLGYLI  49
CeresClone:974460       MFI KVKLPSN----VMIPAEAMDP NGLMIQRAVL RLLDAFASK KATKDLGYFI  50

Consensus               MFI KVKLP------V-IPAE-MDP -GLM-QRA--  IRLL-AF--- KATKDLGY-I  50

Lead-CeresClone-16450   TPTILENIGE----GKIKEQTGEI QFPVVFNGIC FKMFKGEIVH GVVHKVHKTG  99
CeresClone:974460       ALKNLEEIGE----GRIRETTGEI LFPVVFSGIT FKMFKGEIVH GVVRQVHKSG 100

Consensus               ----LE-IGE----G-I-E-TGEI -FPVVF-GI- FKMFKGEIVH GVV--VHK-G 100

Lead-CeresClone-16450   VFLKSGPYEI----YLSHMKMPG TEFIPGENPF FMNQYMSRIQ GARVRFVVL  149
CeresClone:974460       VFLRCGPCEN----VYLSQYKMPG YDYIVEGNPL FMNQNMSRIQ LGSTVRFIVL 150

Consensus               VFL---GP-E-----YLS--KMPG Y--I----NP- FMNQ-MSRIQ IG--VRF-VL 150

Lead-CeresClone-16450   DTEWREAEKD   FMALASIDGD NLGPF     174
CeresClone:974460       DIQWKEAEKE   FIALASLEGN NLGPX     175

Consensus               D--W-EAEK-   F-ALAS--G-  NLGPF     175
```

Figure 103

```
Lead-CeresClone-21863    MPSTPTTPTT TTPITASYWC YSCTRFVSVW ADQGTTTVGS VACPHCDGGF    50
gi|34902106              MASSP----- -----VSYWC YHCSRFVRVF- -------SPST VVCPECDGGF    33
Consensus                M-S-PTTPTT TTPIT-SYWC Y-C-RFV-VW ADQGTT---- V-CP-CDGGF    50

Lead-CeresClone-21863    EQINDSSSA ATELTIPAST ------- EVRSI NNNRR  SVIRRRRSGR RPSFNPVIVL   100
gi|34902106              LEQFPQPPPR GGG------ ------- ---------- ------GSGR RGAMNPVIVL    60
Consensus                -EQ------ ---LTIPAST --------- EVRSI NNNRR  SVIRRR-SGR R----NPVIVL  100

Lead-CeresClone-21863    QGGAGEREEG EEGDAARDRR AFEFYYDDGS GSGLRPLPDS VSEILMGSGF   150
gi|34902106              RGGS------ -------LS  GFELYYDDGS GDGLRPLPGD VSHLLMGSGF    96
Consensus                -GG-GEREEG EEGDAARD-- -FE-YYDDGS G--GLRPLP-- VS--LMGSGF  150

Lead-CeresClone-21863    ERLLEQLSQI EASATGIGRS GNPPASKSAI ESLPRVEISD CHIGSEANCA   200
gi|34902106              HRLLDQFSRL EAAAP----- -RPPASKAAV ESMPSVTVA- ----GSGAHCA  136
Consensus                -RLL-Q-S-- EA-A-GIGRS G-PPASK-A- ES-P-V---D CHIGS-A-CA  200

Lead-CeresClone-21863    VCTEIFETET EAREMPCKHL FHDDCIVPWL SIRNSCPVCR FELP------   244
gi|34902106              VCQEAFEPGA SAREMPCKHV YHQDCILPWL SLRNSCPVCR RELPAAAAPE   186
Consensus                VC-E-FE--- -AREMPCKH- -H-DCI-PWL S-RNSCPVCR -ELPAAAAPE  250

Lead-CeresClone-21863    ---------- RLPRGGFAVG RFAGGPREQL PVVYTELDGG FSNGVGPRRV   244
gi|34902106              SEADAGLTIW RLPRGGFAVG RFAGGPREQL PVVYTELDGG FSNGVGPRRV   236
Consensus                SEADAGLTIW RLPRGGFAVG RFAGGPREQL PVVYTELDGG FSNGVGPRRV  300

Lead-CeresClone-21863    ---------- GGEGRIRRVF ---------- SRPESSSSQS RSG          244
gi|34902106              TWPEGDGHVD GGEGRIRRVF RNLFGCFGRS SRPESSSSQS RSG          279
Consensus                TWPEGDGHVD GGEGRIRRVF RNLFGCFGRS SRPESSSSQS RSG          343
```

Figure 104

```
                                                                                     28
gi|34903896        MGAFLAAPLP           P---FP---LP   PPAPANGGAQ  QQQ---------                41
CeresGdna:1534144  ----MAQLP            PK----PNNMT   PSWPDFS---H  KKSPSICIMG               40
CeresGdna:1479838  ----MAQLP            PK---PN--VT   PSWPDFS---H  KKLPLGIME                37
Lead-CeresClone-34553 ----MAQLP         PK---PTMTT    PNWPDFS---S  QKLPSI                   30
CeresClone:463380  ----MAQLP            PK---PN--MT   PNWPDFSSLH  QKMPSL----QT               40
gi|92871553        ----MAQLP            PKVPIPN--MT   PTWPEFSS--H  QKMPNL----K  SPSNASNF Consensus          ----MAQLP            PK--IPN-MT    P-WPDFS---H  QK-PSI-----  TS-P-DA----  50 gi|34903896        QQQQ----             ----HQPSWV    DEFLDFSATK  RGAHRRSVSD  SVAFLD---PV   66
CeresGdna:1534144  IPTVTANTTA           TVASQNPSWV    DEFLDFSLR    RGTHRRSVSD  SIAFLEEAPT    91
CeresGdna:1479838  TAIV----             --TNPSWV      DEFLGSSTR    RGTHRRSVSD  SIAFRREAPT    80
Lead-CeresClone-34553 GPQQ----          ---QNPSWM     DEFLDFSATR   RGTHRRSISD  SIAFLE---PP   75
CeresClone:463380  TSSN----             ---QNPSWV     DELEFSVAR    RGAPRRSVSD  SVTFLE---AP   68
gi|92871553        SNNQ----             ---QNPSWV     DEFLDFSSTR  RGAHRRSASD  SVTFIE---AS   78

Consensus          T---Q----            ---QNPSWV     DEFLDFS-TR   RG-HRRSVSD  S-AFLE---PT  100 gi|34903896        SDDNAG---            ----VGA       HDFDRLDDDQ   LMSMFSDD--                93
CeresGdna:1534144  MLEECRSTGA           PGLGSRHYSS    SDFDRFDDEQ   FMSMFNDG--                129
CeresGdna:1479838  MLEKCRATGA           PGLGSGHNSS    TDFDKFDDEQ   LMSMFNDD--                118
Lead-CeresClone-34553 SSG----           ---VGN        HHFDRFDDEQ   FMSMFNDDVH  NNNHNHHHHH    111
CeresClone:463380  LLDHHHCKGG           SVVGGG-GGN    NEFERFDDEQ   FMSMFSDEAS  GNNNN-----    112
gi|92871553        MMEHCRRR--           ------DGD     NEFERFDDEQ   LMSMFSVDEV  SRNNT-----    114

Consensus          MLDHCR---G           ---LG------G--  -DFDRFDDEQ  -MSMF-DD--  ---NN------  150 gi|34903896        -LQPPPPQQQ           PAAPAASASS     PSDHNSMNDE   ---------    ---KQDK       126
CeresGdna:1534144  -TSNAVA---           APNSSSSTPSS   PSDHNSINDE    --RE----ATL  SEQQQQQKVR    170
CeresGdna:1479838  -TSNAVA---           APNSSSSTPSS   PSDHNSINDE    --KEAIVVA    SKHKQQQKVR    161
Lead-CeresClone-34553 SINGNVG---        PTRSSSNTXT    PSDHNSLSDD    DNNKEAPPSD  HDHHMDNNVA    158
CeresClone:463380  -NNTMMA---           HTLSSNPST      PSDHNSINDE   --KE--MEN    KEEEKKQLK     153
gi|92871553        -MMPPPA---           TLSSNSNPST    PSDHNSINDE    --KE--EDE    EEKMQQKQLK    155

Consensus          -I-------            ---VA------SSSNPS- PSDHNSINDE  ----KE------ -E---QQKVK  200
```

Figure 104 (Continued)

```
gi|34903896         G E T D - - - - - - - - - - - - E A Q S E C D G A I P G Q P A - - - - - - - S P A T V D    151
CeresGdna:1534144   D E N D - - - - - - - - - - - - E G Q N L S E W E T P S T V P S A T N P A I T - - - - -    204
CeresGdna:1479838   N E N D - - - - - - - - - - - - E G Q S P S E W E T P T T V P T A T D P A A T - - - - -    195
Lead-CeresClone-34553 N Q N N A X G N N Y N E S X E V Q S Q C K T E P X D G P S A N Q N S G G S - - - - -    202
CeresClone-463380   N E S E - - - - - - - - - - - - D E D K S Q C K Q E I T Q L P N N D D S N N T S N A N    194
gi|92871553         H E S D - - - - - - - - - - - - E D E I C E C K Q E N G G V V N D E D D N N G N - - T    194

Consensus           N E N D - - - - - - - - - - - - E - Q S - C K - E T P - - - - - - - - - - - N - - - - -    250 gi|34903896         P K R V K R I L A N R Q S A Q R S R V R K L Q Y I S E L E R S V T S L Q T E V S A L S P R V A F L D    201
CeresGdna:1534144   P K R V K R I L A N R Q S A Q R S R V R K L Q Y I S E L E R S V T S L Q A E V S V L S P R V A Y L D    254
CeresGdna:1479838   P R R V K R I L A N R Q S A Q R S R V R K L Q Y I S E L E R C V T S L Q G E V S V L S P R V A Y L D    245
Lead-CeresClone-34553 P K R V K R I L A N R Q S A Q R S R V R K L Q Y I S X L E R S V T S L Q T E V S V L S P R V A F L D    252
CeresClone-463380   P K R V K R I L A N R Q S A Q R S R V R K L Q Y I S E L E R S V T S L Q A E V S V L S P R V A F L D    244
gi|92871553         P K R V K R I L A N R Q S A Q R S R V R K L Q Y I S E L E R S V T S L Q A E V S V L S P R V A Y L D    244

Consensus           P K R V K R I L A N R Q S A Q R S R V R K L Q Y I S E L E R S V T S L Q A E V S V L S P R V A - L D    300 gi|34903896         H Q R S L L I L G N S H L K Q R I A A L A Q D K I F K D A H Q E A L K K E I E R L R Q I Y - - - - - H    247
CeresGdna:1534144   H Q R L L L N V D N S A L K Q R I A A L S Q D K I F K D A H Q E A L R T E I E R L R Q V Y - - - - - Q    300
CeresGdna:1479838   H R R L L L N V D N S A I K Q R I A A L A Q D K I F K D G N S S R S I E E G N R E A K A S V S S T E    295
Lead-CeresClone-34553 H Q R L L L N V D N S A L K Q R I A A L A Q D K I F K D A H Q E A L K R E I E R L R Q V Y - - - - - H    298
CeresClone-463380   H Q R L L L N V D N S A I K Q R I A A L A Q D K I F K D A H Q E A L K R E I E R L R Q V Y - - - - - -    290
gi|92871553         H Q R L L L N V D N S A I K Q R I A A L A Q D K I F K D A H Q E A L K R E I E R L R Q V Y - - - - - H    290

Consensus           H Q R L L L N V D N S A L K Q R I A A L A Q D K I F K D A H Q E A L K R E I E R L R Q V Y - - - - - H    350 gi|34903896         Q Q S L K N A E S Q P A D A A P V R G R D N A D L I G S - - E G A A A A A P C P H S - -    287
CeresGdna:1534144   Q Q N L K K M D K T N S - - - - S I N Q N K - - - - - - - - - - - - - - - - - - - - - -    317
CeresGdna:1479838   P Q D G K Y F T T I S - - - - - I N P I K - - - - - - - - - - - - - - - - - - - - - - -    312
Lead-CeresClone-34553 Q Q S L K K M E N N - - - - V S D Q S P A D I - - - - K P S V E K E Q L L N V - -    329
CeresClone-463380   Q Q N I K K M D N N A A A S P P S Q S P S P S P K P R C - - E T H T E K E Q L I N V - -    330
gi|92871553         Q Q - - Q N I K N N A T A A - - A V S P S P S P K P R C D N D T H I E N E H L I N V - -    328

Consensus           Q Q - L K - M - N N - - - - A - - - I - - S P - - - - - - - - - - - - E - - - - E - - - - E - L I N V    392
```

Figure 105

```
Lead-CeresClone:40196   MMVEMDYAKK MQKCH----E YVEALEEEQK KIQVFQRELP LCLELVTQAI   46
CeresClone:467905       ---------- MQPLKMGFLQ YIEALEEERR KIQVFPKELP LSLELVTQAI   46
Consensus               MMVEM---A-K MQ-----MGFL- Y-EALEEE-- KIQVF--ELP L-LELVTQAI   50

Lead-CeresClone:40196   EACRKELSGT IT------ITSE QCSEQTTSVQ GGPVFEEFIP IKKISSLCEE   92
CeresClone:467905       EACRQQLAGT VAEYNLNGQS ECSEQIST-- DGPVFEEFIP LKKRASQDSV   94
Consensus               EACR---L-GT --EYNL----- --CSEQT--VC -GPVFEEFIP -KK--S----  100

Lead-CeresClone:40196   VQEEEEEDGE HESSPELVNN KKSDWLRSVQ LWNHSPDLNP KEERVAKKAK  142
CeresClone:467905       EEEDEDEEHF HKHKKTATDK KKSDWLRSVQ LWNPNPPPTK EDVVVPRKTD  144
Consensus               --E-E-E---- H--------- KKSDWLRSVQ LWN--P---- ----V--K--  150

Lead-CeresClone:40196   VVEVKPKSGA FQPFQKRVLE TDLQPAVKVA SSMPATTTSS ITETCGGKSD  192
CeresClone:467905       VVEVKRNGGA FQPFQREEKS GDAKASI NND ASAI GKAPSS PPVPATSSTG  194
Consensus               VVEVK----GA FQPFQ----- --D------- --S------SS ----------  200

Lead-CeresClone:40196   LIKAGDEERR EQQQSQSHT HRKQRRCWSP ELHRRFLNAL RPAATSVAAQ  242
CeresClone:467905       PVRVEN----- KKEEKGQA QRKQRRCWSQ ELHKRFLHAL RSPIIHNNAS  238
Consensus               ------EERR IE-------- -RKQRRCWS- ELH-RFL-AL R---------  250

Lead-CeresClone:40196   STGNQ----- DGLTNDEVKS HLQKYRLHTR RPAATSVAAQ QQLGGSHVAT  287
CeresClone:467905       SQAGPLFLVG DGLTNDEVKS HLQKFRLHTR RSPIIHNNAS QQLGGADSAT  288
Consensus               S------LFLVG DGLTNDEVKS HLQK-RLHTR R-------A- QQLGG---AT  300

Lead-CeresClone:40196   ---QQPQFV VVGGIWVPSS QDFPPPSDVA NKGGVYAPVA VL--------  324
CeresClone:467905       NIFVQPPEYA AVATISTASG EELTVITTT- APTGIYAPVA AHPPAVTHTL  338
Consensus               NIFVQ-P---- --V-------- --S------- ---G-YAPVA -HPPAVTHTL  350
```

Lead-CeresClone-40196  ----AQSPKR  SLERS-----  CNSPAASSST  NTNTSTPVS-  -
CeresClone:467905      PIMKQKEHSH  SEERPNHSVL  SNSPASSSST  HITTSPPVP   N Consensus              PI MK-----  S-ER-NHSVL  -NSPA-SSST  -T-T---P--P  N
```

Figure 107 (Continued)

```
Lead-CeresClone-113719  SRTEGPRCYN  PVPVSGLGQ   QFGKLLESGK  GADVTFEVDG  EULFPAHKLVL  173
gi|50939715             SHTEGPKIYT  PVPPSNMSQ   HIGQLLTDCK  RTDITFEVDG  EVFPAHKVVL   250
CeresClone:288779       SHTEGPKIYT  PVPRSNMAL   HIGQLLTSGK  RTDIAFEVDG  EMFPAHKVIL   241
CeresClone:713993       SHTEGPKIYT  AIPPSSIGQ   KFGQLLESGK  GSDVNFEVNG  DIFAAHKLVL   225
CeresGdna:1513206       SHTEGPKIYT  AVPPSNIGQ   HFGKLLLDSGK RTDVNFEVDG  EICASHKIVL   173

Consensus               SHTEGPKIYT  IPVPPSN-GQ  HFGQLLESGK  RTDV-FEVDG  EVFPAHK-VL   250

Lead-CeresClone-113719  AARSAVFRAQ  LFGPLRSENT  NCITEDVQA   PITFKMLLHFI YWDEMPDMQD   223
gi|50939715             AARSPVFRAQ  LFGPMKDKNM  KRITIEDMEA  SVFKALLHFM  YWDELPDIEE   300
CeresClone:288779       SARSPVFRAQ  LFGPMKDKDM  KCIKIEDMEA  PVFKALLHFI  YWDELPDLEE   291
CeresClone:713993       AARSPVFRAQ  LFGPMKDQNT  QRIKVEDMEA  PVFKALLHFI  YWDSLPDMQE   275
CeresGdna:1513206       AARSPVFRAQ  LFGPMKDQNT  QCIKVEDMEA  PVFKALIHFI  YWDALPDMEE   223

Consensus               AARSPVFRAQ  LFGPMKD-NT  -CIKIEDMEA  PVFKALLHFI  YWDELPDMEE   300

Lead-CeresClone-113719  LLGLDLKWAS  TLVAQHLLAA  ADRYALERLR  TICESKLCEG  ISINTVATTL   273
gi|50939715             LTGLNTIMVS  TLMAQHLLAA  ADRYALERLK  LLCELKLCED  VAINTVANTL   350
CeresClone:288779       LTGVNTIMVS  TLMAQHLLAA  ADRYALERLK  LLCELKLCED  VAINTVANTL   341
CeresClone:713993       LTGLNSKWAS  TLMAQHLLAA  ADRYGLERLR  LMCEASLCED  VAINTVATTL   325
CeresGdna:1513206       LVGLNSKWAS  TLMAQHLLAA  ADRYALERLR  LLCEARLCED  VAINTVATTL   273

Consensus               LTGLN-KWAS  TLMAQHLLAA  ADRYALERLR  LLCEAKLCED  VAINTVATTL   350

Lead-CeresClone-113719  ALAEQHHCFQ  KATCLKFIA   LPENLKAVME  TDGFDYLKES  CPSLLSELLE   323
gi|50939715             ALAEQHHCYQ  KTVCLKRFVA  LPENLKAVMQ  DGFDYLQQS   CPSLLTELLE   400
CeresClone:288779       ALAEQHHCYQ  KTVCLKFVA   LPENLKAVMQ  DGFDYLQQS   CPSLLTELLE   391
CeresClone:713993       ALAEQHHCFQ  KAVCLKFIA   TSENLRAVMQ  DGFEYLKES   CPSVLTELLE   375
CeresGdna:1513206       ALAEQHQCTQ  LKSVCLKFIA  LPENLKAVMQ  DGFEYLKES   CPSVITELLQ   323

Consensus               ALAEQHHC-Q  LK-VCLKFIA  LPENLKAVMQ  TDGFDYLKES  CPSLLTELLE   400
```

Figure 107 (Continued)

| | | | | |
|---|---|---|---|---|
| Lead.CeresClone-113719 | YVARLSEHSL | TSSGHRKELF | ADGCDLNGRR | VKQRLH | 359 |
| gi\|50939715 | YVAKVGEHSV | SPCLYSNEVL | -DGGDANGRR | VKPRI- | 434 |
| CeresClone:288779 | YVAKIGEHSV | SPCLYSTEVL | -DGGDANGRR | VKPRI- | 425 |
| CeresClone:713993 | YVARFTEHSD | IMCKHRNEAL | LDGSDINGRR | VKQRL- | 410 |
| CeresGdna:1513206 | YVAKNGEHSV | IACTHGNDNL | --DSDMNGRR | VKQRIH | 357 |

Consensus  YVAK-GEHSV  T-C-H-NEVL  -DG-D-NGRR  VKQRI-  436

Figure 108

|  | | | | | | |
|---|---|---|---|---|---|---|
| gi\|55741380 | -MPPPLSFLH | ----- | ----LAANPT | PLHASPLRRA | RLRHRL-SLR | TDHPSRRAVA | 44 |
| gi\|92881423 | MNTLSLHFYT | ----- | -----PHSF | LSLKP----- | ---------- | ---------- | 19 |
| Lead-CeresClone-150246 | MSLFCNSIET | ----- | ----LYPKPF | LSHKS----- | HFFTFSI-NSK | FQNPKFTSFP | 40 |
| CeresGdna:1486526 | MTPLCKAIDT | ----- | TTASLLKPSI | LLHKTPLNFC | HSLNYTPNLS | NNNTTSKP | 50 |

Consensus    M-PLCLS---T    ------L-P--F    L-HKSPL----    H--------NL-    --NP---TS-P    50

| gi\|55741380 | ------SASASA | GENPSTPCGP | ADVEMVRCK | DGVWTARPPT | VVVLWDLDNK | 90 |
|---|---|---|---|---|---|---|
| gi\|92881423 | ------KPQPR | TQCCSTNNNL | DDIDMVKTK | QGITYEQKQNK | VCVLWDLDNK | 64 |
| Lead-CeresClone-150246 | ------LRHQCR | IESCLKSASS | -SEIDMVRNK | EGIFAPKEKK | VVVLWDLDNK | 85 |
| CeresGdna:1486526 | PQNHLRPITA | TANASHPAAT | -SEIDMVKNR | QGIYTSKQNK | VVVLWDLDNK | 99 |

Consensus    ------LRPQ---    IENCST-A---    IS-IDMV-NK    QGVYT-KQNK    VVVLWDLDNK    100

| gi\|55741380 | PPRGPPFPAA | TALRDAASLL | GRVVSVSAFA | NRHAFSHVPA | WVADERRERR | 140 |
|---|---|---|---|---|---|---|
| gi\|92881423 | PPRGPPYNAA | VSLKNLAERF | GDMIDISAYA | N:RHAFIHLPQ | WVLNQRRERK | 114 |
| Lead-CeresClone-150246 | PPRGPPYEAA | TALRKVAEKL | GRVVEISAYA | NRHAFIHLPH | WVEERRERR | 135 |
| CeresGdna:1486526 | PPRGPPYPAA | MALKTVAQRF | GEMIDMCAYA | NRHAFIHLPH | WVLEERRERK | 149 |

Consensus    PPRGPPYPAA    -AL--VAER-    G-VVDISAYA    NRHAFIHLPH    WVLEERRER-    150

| gi\|55741380 | AMDRAERAGA | ASPPVPYSCA | VCGRRFPTRP | DLTRHFRQLH | QRERNKKLSR | 190 |
|---|---|---|---|---|---|---|
| gi\|92881423 | NLDILERKGI | LNPPEPYVCS | VCGRKCKTNV | DLKKHFKQLH | QRERQKKLNR | 164 |
| Lead-CeresClone-150246 | NLDFMERKGE | VTPIDPYICG | VCGRKCKTNL | DLKKHFKQLH | ERERQKKVNR | 185 |
| CeresGdna:1486526 | HLDILERKEI | VSPSQPYVCG | VCGRKCKTNL | DLKKHFKQLH | ERERQKKVNR | 199 |

Consensus    NLDILERKGI    VSPP-PYVC-    VCGRKCKTNL    DLKKHFKQLH    -RERQKK-NR    200

| gi\|55741380 | LRSLKGKKRQ | TKYDDAAREL | LPKVGYGLA | AELRRAGVHV | 240 |
|---|---|---|---|---|---|
| gi\|92881423 | LNSLKGKKRQ | DKYNDAVREI | LKPKVGYGLA | SELRRAGVFV | 214 |
| Lead-CeresClone-150246 | MRSLKGKKRQ | EKYNEAARSL | LTPKVGYGLE | AELRRAGVYV | 235 |
| CeresGdna:1486526 | MRSLKGKKRQ | HKYNEFARRL | LTPKIGYGLA | AELKRAGVYV | 249 |

Consensus    -RSLKGKKRQ    K-KERFVSGN    -KYN-AAREL    LTPKVGYGLA    AELRRAGVYV    250

Figure 108 (Continued)

```
gi|55741380          RTVSDKPQAA DWALKRQVKH SVACGVDWLV LVSDDSDFTD TVRKARAADL    290
gi|92881423          KTVEDKPQAA DWALKKQMMH SMSRGIDWLF LVSDDSDFSE MLRKAREADL    264
Lead-CeresClone-150246  KTVEDKPQAA DWAVKRQIQH SMTRGIDWLV LVSDDKDFSD MLRKAREADL 285
CeresGdna:1486526    KTVEDKPQAA DWALKRQIEH SMSRGVDWLV LVSDDSDFSE ILRKAREANL    299

Consensus            KTVEDKPQAA DWALKRQI-H SMSRG-DWLV LVSDDSDFS- MLRKAREA-L    300 gi|55741380          RTVVVGDGCR ALGSVADIWL PWDRVENGEV DEDMRNGTH  MGFR----DE    336
gi|92881423          GTVVVGDVDR ALGRHADLWV PWNAVENGEV MDMDLIPRNR DRRR----TNS   311
Lead-CeresClone-150246  GTLVVSDMDR ALGRHADLWV PWSGVEKGEI GEKDLIPGKR PRFE-----   329
CeresGdna:1486526    GTVVVGDRDR ALGRHADLWV PWIGVENGEL TEKDLVPKGR WRSEDLENDE    349

Consensus            GTVVVGD-DR ALGRHADLWV PW-GVENGEV -EKDLIP--R -RF------DE    350 gi|55741380          EEDEQDDDEF VDWDTSD-L  DGVVDDIVAT RTKLFGAITM SAFADEEIMD    385
gi|92881423          TSTTMDDFGD VLFFHEGEEM E----DDFMLE  FSVVRMMRMR ----D DDFDED--    348
Lead-CeresClone-150246  ED------- EVGFGGNDEL FSVVRMMRMR ---- -------    354
CeresGdna:1486526    GLFSVTDFDE DGDYGGNDL  EGFVDGLVMA RSG-FNGTRI SAFSE------   392

Consensus            ----DDFED -VDFGGNDEL EGVVDD-VM- RS--F--T-- SAF-E------   400 gi|55741380          GILGVGINGG DMLWSDDED  EDGYFL----                              410
gi|92881423          ---------  ---SDEED   EDGFYIY---                              360
Lead-CeresClone-150246  ---------  -----GEEED  EQDYLYDSE YEEIELEDGG FW              354
CeresGdna:1486526    ---------  ---SDEED   EDGY---Y--                              419

Consensus                                                                           442
```

Figure 109

```
CeresClone:1370494      MSVLLPLCLV-          -LSMI TYSNAA        YCVCKDG-NE  QVLQKAIDYA  CGAGADCSQI   49
Lead-CeresClone:206045  M-FLTILLC--          ---------             --------- ----------  ---------    7
gi|16323412             MSVLLPLCLI-          ISMFTYSNAA           YCLCKEG-NE  QVLQKAIDYA  CGNGADCTQI   49
CeresGdna:1464350       MAVLVFLGLF           LALTGHSSAT           YCICKDGVGD  TQLQKSLDYA  CGAGADCTQI   50
CeresClone:584351       MALLMYFVLF           LALAGHSSAL           YCVCKDGVGD  QALQKAIDYA  CGAGADCTPI   50

Consensus               M-VLL-LCL-           L-----S-A-           YCVCKDG---  Q-LQKAIDYA  CGAGADCTQI   50

CeresClone:1370494      QQNGACFQPN           TVKNHCDVAV           NSYYQKKASS  GATCDFNGAA  VIST SPPSTA   99
Lead-CeresClone:206045  -------                ---------           ---------   ---------  ---------    7
gi|16323412             QPTGACYQPN           TVKNHCDVAV           NSYYQKKASS  GATCDFNGAA  SPSTTPPSTA   99
CeresGdna:1464350       IQNAPCYQPN           TVKDHCSYAV           NSYFQKKGQA  VGSCDFSGTA  MTSATPPQSV  100
CeresClone:584351       LQNGACFQPN           TVKDHCNYAV           NSYFQRKGQA  GGSCDFSGAA  TPSQTPPTAA  100

Consensus               -QNGAC-QPN           TVK-HC--AV           NSY-QKK---  --CDF-GAA   --S-TPPS-A  100

CeresClone:1370494      SSCLTCSSS            GTPSTGTPTT           GTPSTGTPTT  GTPSTG----  TPTTGTPTSG  145
Lead-CeresClone:206045  ---SSS               ---------            GTPTTGTPTT  GTPTTG----  TPTTGTPTSG   46
gi|16323412             SNCLTCSSS            GTPTTGTPTS           GTPTTGTPTT  GTPTTG----  TPTTGTPTSG  145
CeresGdna:1464350       ASGCHYPASA          TPSTG--              NTPTTTPST   GTTPTG----  ---TGTTPLG-  140
CeresClone:584351       STCV-YPSSP          SNAGT--              ATPTTTPT    GTPPTTLTPT  TPTSTTLPGTG 147

Consensus               SSCLT--SSS           GTP-TGTPTT           GTPTTGTPTT  GTPTTG----  TPTTGTPTSG  150

CeresClone:1370494      FPSTGTPSTG           TPTAGMPTTG           TPSTGMPNSG  TPANGMPTSS  SSSVFPGTTL  195
Lead-CeresClone:206045  TPTSGFPNTG           TPNT-GT              ---NTGMPNS  ---NGMPTSS  SSSVFPGTTL   86
gi|16323412             TPTSGFPNTG           TPNT-GT              ---NTGMPNS  ---NGMPTSS  SSSVFPGTTL  185
CeresGdna:1464350       TGTSTGTG             T-GT                 ---GTTPSS   ---GTTPTP   PSSVFNSG--  175
CeresClone:584351       TGTTTGTG             T-GT                 ---TTGNPNV  ---FGMSPTS  STG-------  179

Consensus               TPTSGTPNTG           TP-TGT               ---TGMPNS-  ---NGMPTSS  SSSVFPGTTL  200
```

CeresClone:1370494     GPTGSGGFGD  PNAGEKISVR  TNTAF------  FLLTGVAIML  VV
Lead-CeresClone:206045 GPTGSGGLGD  PNAGEKLSVR  TNTLV------  LLLTGVAAML  VI
gi|16323412            GPTGSGGLGD  PNAGEKLSVR  TNTVV------  FLLTGVAAML  VI
CeresGdna:1464350      --LGPTGFND  NSSEAPAFKG  TNLWFIASLT   LLFSGIFLFW  G-
CeresClone:584351      --TG-GGFND  SNKGVVHLQD  TSMLLVS---   LVLTLLVLX   RV Consensus              GPTGSGGFGD  PNAGEKLSVR  TNTLV------  FLLTGVA-ML  V-   242
```

Figure 110

| | | | |
|---|---|---|---|
| CeresClone:710471 | MAT-----R VLLLMALTLY IFPIATAT-- ----FHVKCS VYCDTCRAGF | 38 |
| gi\|25990491 | MSKLYF-----L AFVAVASLSF RLSLADPN-- --PTFIVEGR VYCDSCRAGF | 43 |
| gi\|50923969 | MASL-----R TIPVIFGILF YVLASTATAT DAPDYVVQGR VYCDTCRAGF | 45 |
| Lead-CeresClone-207834 | MASIPA---T TFAVILSVLF CAAAGIAVDN DLPDYVIQGR VYCDTCRAGF | 47 |
| CeresClone:384289 | MASVPAPATT TAAVILCLCV VLSCAAADDP NLPDYVIQGR VYCDTCRAGF | 50 |

Consensus    MASL-----  T---VI--LLF  -LS-ATA---  D-PDYVVQGR  VYCDTCRAGF  50

| | | | |
|---|---|---|---|
| CeresClone:710471 | ETNATFYI RG ARVGIQCKER KTMKVAFYSE GVTDSTGTYH IEVENDHRDN | 88 |
| gi\|25990491 | ETNITIMY EG AKVKLECRHF DNDSIAHIVE GVTNSTGTYS QLENDHESE | 93 |
| gi\|50923969 | ETNVTEYI KG AKVRLECKHF CTDKVERAID GVTDELCTYK ELKDSHEED | 95 |
| Lead-CeresClone-207834 | VTNVTEYI AG AKVRLECKHF GTGKLERSID GVTDGNGTYT ELKDSHEED | 97 |
| CeresClone:384289 | VTNVTEYI AG AKVRLECKHF GTGKLERAID GVTDATGTYT ELKDSHEED | 100 |

Consensus    ETNVTEYI -G  AKVRLECKHF  GT-K-ER-ID  GVTDSTGTYT  IELKDSHEED  100

| | | | |
|---|---|---|---|
| CeresClone:710471 | ICECLLVKSP IKMCSTPDSG SQNGIVNHLH YANAMCYLRD | 138 |
| gi\|25990491 | CEVVLVSSP FDCNEIDYD N-NGIDSPIR YANSLGFLQE | 142 |
| gi\|50923969 | CEVVLVHSP LANCSEIEAE N-VGICONLR LANPLGYLKD | 144 |
| Lead-CeresClone-207834 | CEVVLVESP RKDCDCDQVQAD N-VGISDNLR PANPLGYLKD | 146 |
| CeresClone:384289 | CQVVLVASP RKDCDEVQAL N-VGISDSLR PANPLGYFKD | 149 |

Consensus    ICEVVLV-SP  IKDC-E--AD  RDRA-VLLTR  N-VGI-DNLR  -ANPLGYLKD  150

| | | |
|---|---|---|
| CeresClone:710471 | EPLPECHKLL KYYLADSDV-- | 157 |
| gi\|25990491 | QPDI-CGDLL KAYGIADP--- | 160 |
| gi\|50923969 | LPLPICGALL KQFDLADDDN E | 165 |
| Lead-CeresClone-207834 | VPLPICASLL KQLDSDDDDD Q | 167 |
| CeresClone:384289 | VPLPVCAALL KQLDSDDDDD Q | 170 |

Consensus    VPLPIC-ALL  KQYDSDDDDD  Q  171

Figure 112

| | | | | | | |
|---|---|---|---|---|---|---|
| gi\|61338425 | MATPPVKIA | CIGAGYVGGP | TMAVIALNSP | DIEVVVVDIN | EERIKAWNSE | 50 |
| CeresGdna:1450213 | -----MVKIC | CIGAGYVGGP | TMAVIALKCP | SIEVVVVDIW | EPRIAAWNSD | 45 |
| gi\|39939262 | -----MVKIC | CIGAGYVGGP | TMAVIALKCP | SIEVVVVDIS | EPRIAAWNSD | 45 |
| CeresClone:9930 | -----MVKIC | CIGAGYVGGP | TMAVIALKCP | DVEVAVDIS | VPRIKSRIAAWNSD | 45 |
| gi\|6136119 | -----MVKIC | CIGAGYVGGP | TMAVIALKCP | SIEVAVVDIS | VARIAAWNSE | 45 |
| gi\|40317278 | -----MVKIC | CIGAGYVGGP | TMAVIALKCP | SIEVAVVDIS | VPRITAWNSD | 45 |
| gi\|48093459 | -----MVKIC | CIGAGYVGGP | TMAVIALKCP | AIEVVVVDIS | EPRIAGWNSE | 45 |
| Lead-CeresClone-382867 | -----MVKIC | CIGAGYVGGP | TMAVIALKCP | DVEVVVVDIS | APRIEGWNSE | 45 |
| gi\|50582697 | | | | | | 29 |
| Consensus | -----MVKIC | CIGAGYVGGP | TMAVIALKCP | SIEVVVVDIS | EPRIAAWNSD | 50 |
| gi\|61338425 | TLPIYEPGLD | EVVKAARGRN | LFFSTDLKKH | VGEADIVFVS | AIGKVLKRNC | 100 |
| CeresGdna:1450213 | QLPIYEPGLY | DVVKECRGRN | LFFSKDVEKH | VAEADIVFVS | AIEKILTHNS | 95 |
| gi\|39939262 | QLPIYEPGLY | DVVKECRGRN | LFFSKDVEKH | VAEADIVFVS | AIEKILTHNS | 95 |
| CeresClone:9930 | TLPIYEPGLD | DVVKQCRGKN | LFFSTDVEKH | VREADIVFVS | AIEKILTHNS | 95 |
| gi\|6136119 | QLPIYEPGLD | GVVKQCRGRN | LFFSTDIEKH | VFEADIVFVS | AIEKILTHNS | 95 |
| gi\|40317278 | QLPIYEPGLE | DVVKQCRGRN | LFFSTDVEKH | ISEADIIFVS | AIEKILTHNS | 95 |
| gi\|48093459 | QLPIYEPGLE | DVVKECRGRN | LFFSTEVHRH | VREADIVFVS | AIEKILTHNS | 95 |
| Lead-CeresClone-382867 | RLPIYEPGLD | DVVRQCRGRN | LFFSTDVERH | VGDADIVFVS | AIEKICGL | 95 |
| gi\|50582697 | RLPIYEPGLD | DVVRQCRGRN | LFFSTDVERH | VADAGIVFVS | AIEKILAHNS | 79 |
| Consensus | QLPIYEPGLD | DVVKQCRGRN | LFFSTDVEKH | V-EADIVFVS | AIEKILTHNS | 100 |
| gi\|61338425 | GAGKAADLTY | WECAARLIAS | VSTSSKIVVE | KSTVPVKTAE | AIGKVLKRNC | 150 |
| CeresGdna:1450213 | GAGKAADLTY | WESAARTIAD | VSKSDKIVVE | KSTVPVKTAE | AIEKILTHNS | 145 |
| gi\|39939262 | GAGKAADLTY | WESAARTIAD | VSKSDKIVVG | KSTVPVKTAE | AIEKILTHNS | 145 |
| CeresClone:9930 | GAGKAADLTY | WESAARMIAD | VSVSDKIVVE | KSTVPVKTAE | AIEKILTHNS | 145 |
| gi\|6136119 | GAGKAADLTY | WESAARMIAD | VSKSDKIVVE | KSTVPVKTAE | AIEKILTHNS | 145 |
| gi\|40317278 | GAGKAADLTY | WESAARMIAD | VSKSDKIVVE | KSTVPVKTAE | AIEKILTHNS | 145 |
| gi\|48093459 | GAGKAADLTY | WESAARMIAD | VSKSDKIVVE | KSTVPVKTAE | AIEKILTHNS | 145 |
| Lead-CeresClone-382867 | GAGKAADLTY | WESAARIIAD | VSRSDKIVVE | KSTVPVKTAE | AIEKILVHNS | 145 |
| gi\|50582697 | GAGKAADLTY | WESAARIIAD | VSRSDKIVVE | KSTVPVKTAE | AIEKILAHNS | 129 |
| Consensus | GAGKAADLTY | WESAARMIAD | VSKSDKIVVE | KSTVPVKTAE | AIEKILTHNS | 150 |

Figure 112 (Continued)

```
                        SDPSVNFEIL  SNPEFLAEGT  AI EDLQKPDR  VLI GGVDTPS  GQAAVAALKW  200
gi|61338425             KG----KFQIL  SNPEFLAEGT  AI GDLFQPDR  VLI GGRETPE  GQKAI QALKD  193
CeresGdna:1450213       KG----KFQIL  SNPEFLAEGT  AI GDLFQPDR  VLI GGRETPE  GQKAI QALKD  193
gi|39939262             KG----KFQIL  SNPEFLAEGT  AI KDLFNPDR  VLI GGRETPE  GEKAVQTLKD  193
CeresClone:9930         KG----KFQIL  SNPEFLAEGT  AI KDLFNPDR  VLI GGRETPE  GQKAI QTLKD  193
gi|6136119              RG----NFQIL  SNPEFLAEGT  AI EDLFKPDR  VLI GGRETPE  GQKAI QALKD  193
gi|40317278             KG----NFQIL  SNPEFLAEGT  AI EDLFKPDR  VLI GGRETPG  GQKAI QALKD  193
gi|48093459             RG----VRYQIL SNPEFLAEGT  AVQDLFAPDR  VLI GGRETPE  GRAAVARLRD  193
Lead-CeresClone-382867  KGGNI RYQIL  SNPEFLAEGT  AI QDLFSPDR  VLI GGRETPE  GRAAVAALKS  179
gi|50582697

Consensus               KG---I KFQIL  SNPEFLAEGT  AI EDLFKPDR  VLI GGRETPE  GQKAI QALKD  200 gi|61338425             VYNHWI PVER  LTANLWSAE   LAKLTANAFL  AQRI SSI NSI  SALCEASGAN  250
CeresGdna:1450213       VYAHWVPEDR  LTTNLWSAE   LSKLAANAFL  AQRI SSVNAM  SALCEATGAD  243
gi|39939262             VYAHWVPEDR  LTTNLWSAE   LSKLAANAFL  AQRI SSVNAM  SALCEATGAD  243
CeresClone:9930         VYAHWVPEGQ  LTTNLWSAE   LSKLAANAFL  AQRI SSVNAM  SALCEATGAD  243
gi|6136119              VYAQWVPEER  LTTNLWSAE   LSKLAANAFL  AQRI SSVNAM  SALCEATGAN  243
gi|40317278             VYAHWVPEDR  LATNLWSAE   LSKLAANAFV  AQRI SSI NAM  SALCEATGAN  243
gi|48093459             VYAQWVPEDR  LTTNLWSAE   LSKLAANAFL  AQRI SSVNAM  SALCEATGAN  243
Lead-CeresClone-382867  VYAQWVPGDR  LTTNLWSAE   LSKLAANAFL  AQRI SSVNAI  SALCEATGAD  243
gi|50582697             YARWVPDDR   I TTNLWSAE  LSKLAANAFL  AQRI SSVNAI  SALCEATGAD  229

Consensus               VYAHWVPEDR  I LTTNLWSAE  LSKLAANAFL  AQRI SSVNAM  SALCEATGAD  250 gi|61338425             VQQVAHAI GT  DTRI GNKFLS  ASVGFGGSCF  QKDI LNLCYV  CETLGLREVA  300
CeresGdna:1450213       VAEVAYAVGK  DSRI GPKFLN  ASVGFGGSCF  QKDI LNLVYI  CECNGLPEVA  293
gi|39939262             VAEVSYAVGK  DSRI GPKFLN  ASVGFGGSCF  QKDI LNLVYI  CECNGLPEVA  293
CeresClone:9930         VTQVSYAVGT  DSRI GPKFLN  SSVGFGGSCF  QKDI LNLVYI  CECNGLPEVA  293
gi|6136119              VQQVSYSVGT  DSRI GPKFLN  ASVGFGGSCF  QKDI LNLVYI  CECNGLPEVA  293
gi|40317278             VTEVAYAVGK  DSRI GPKFLN  ASVGFGGSCF  QKDI LNLVYI  CECNGLPEVA  293
gi|48093459             VSQVAYAVGK  DSRI GPKFLN  ASVGFGGSCF  QKDI LNLVYI  CECNGLPEVA  293
Lead-CeresClone-382867  VTEVAHSVGR  DARI GPRFLS  ASVGFGGSCF  QKDI LNLVYI  CECYGLPEVA  293
gi|50582697             VTEVANSI GK  DSRI GPRFLS  ASVGFGGSCF  CKDI LNLVYI  CECYGLPEVA  279

Consensus               V-EVAYAVGK  DSRI GPKFLN  ASVGFGGSCF  QKDI LNLVYI  CECNGLPEVA  300
```

Figure 112 (Continued)

| | | | | | |
|---|---|---|---|---|---|
| gi\|61338425 | IFDGRNVLDH | DKLREI GFIT | YALGKPLDPF | LQKVY------ | 483 |
| CeresGdna:1450213 | VFDGRNVVNA | DKLREI GFIV | YSI GKPLDAW | LKDMP------ | 478 |
| gi\|39939262 | VFDGRNVVNA | DKLREI GFIV | YSI GKPLDAW | LKDMP------ | 478 |
| CeresClone:9930 | VFDGRNI MNL | QKLREI GFIV | YSI GKPLDDW | LKDMP------ | 477 |
| gi\|6136119 | VFDGRNI VDA | DKLREI GFIV | YSI GKPLDPW | LKDMP------ | 477 |
| gi\|40317278 | VFDGRNI VDV | EKLRKI GFIV | FSI GKPLDPW | LKDMP------ | 477 |
| gi\|48093459 | IFDGRNVVDM | EKLREI GFIV | YSI GKPLDAW | LKDMPLSLNC | 492 |
| Lead-CeresClone-382867 | VFDGRNVVDP | AKLREI GFVV | YAI GKPLDDW | LKDMP------ | 478 |
| gi\|50582697 | LFDGRNVVDP | DKLRRI GFVV | YSI GKPLDHM | LRDMP------ | 463 |
| | | | | | |
| Consensus | VFDGRNVVD- | DKLREI GFIV | YSI GKPLD-W | LKDMP------ | 500 |

| | | | | | |
|---|---|---|---|---|---|
| gi\|61338425 | ---------- | ---------- | ---------- | ---------- | 483 |
| CeresGdna:1450213 | ---------- | ---------- | -A | A | 481 |
| gi\|39939262 | ---------- | ---------- | -A | A | 481 |
| CeresClone:9930 | ---------- | ---------- | -A | VA | 480 |
| gi\|6136119 | ---------- | ---------- | -A | VA | 480 |
| gi\|40317278 | ---------- | ---------- | -A | VA | 480 |
| gi\|48093459 | IKDI SYMRQS | AGI LTI FFFY | HVQFCFVLSH | VG | 524 |
| Lead-CeresClone-382867 | ---------- | ---------- | -A | VA | 481 |
| gi\|50582697 | ---------- | ---------- | -A | VA | 466 |
| | | | | | |
| Consensus | ---------- | ---------- | ---------- A | VA | 532 |

Figure 113

| | | | | |
|---|---|---|---|---|
| Lead-cDNA-ID:12575172 | MPKSVKPIS- | ----ESDKLS | DHLRDSSLTS | EINKPDFREL | DLGSPVSPLR | 45 |
| CeresGdna:1519981 | MSHSPKPSIG | GGNLDLNSLT | DQLRDSLSSF | EANKPDFREL | DLGSPVSPLR | 50 |
| Consensus | M--S-KP--G | GGNL------ | D-LRDS---- | E-NKPDFREL | DLGSPVSPLR | 50 |

| | | | | | |
|---|---|---|---|---|---|
| Lead-cDNA-ID:12575172 | SQPRGLTTT- | ----TTTT- | TTSSSSSSSS | GSVTGRIKHA | PVIGRSNSVR | 88 |
| CeresGdna:1519981 | TRGGLITTTT | ATATAATTTI | TITSSSSSSS | GSASG----- | ---AQNPL | 90 |
| Consensus | -----TTTT | ATATAATTTT | TT-SSSSSSS | GS--GRIKHA | PVIGR----- | 100 |

| | | | | | |
|---|---|---|---|---|---|
| Lead-cDNA-ID:12575172 | SQSNSSSGNN | NLRPRSDSAT | TSSSSHSQPI- | ----LLSSS | SSSATSPAPT | 132 |
| CeresGdna:1519981 | HKPNNSNHSG | ELSNSSESSP | TAGAKKGQPG | HSRSDSLTYS | GQITSQSAVN | 140 |
| Consensus | ---N-S---- | -L---S-S-- | T------QPG | HSRSD-L--S | ------A-- | 150 |

| | | | | | |
|---|---|---|---|---|---|
| Lead-cDNA-ID:12575172 | SPA---NVLPT | GNICPSGKIQ | -T---GMTQSR | SRSDVLGSGT | GTYGHGSIMR | 178 |
| CeresGdna:1519981 | SPATGNVLPT | GNICPSGRIL | KTGMGMANRS | AKADVLGSGI | ANYGHGSIMR | 190 |
| Consensus | SPATGNVLPT | GNICPSG-I- | -TGMGM---- | ---DVLGSGT | ---YGHGSIMR | 200 |

| | | | | | |
|---|---|---|---|---|---|
| Lead-cDNA-ID:12575172 | GGGISPAKPT | NTGGGSNSPV | NVGSSSRSSS | TVATGETPIW | KKAILGSDSE | 228 |
| CeresGdna:1519981 | GGSAKCANL | DV-------- | -VNSASRNAW | SVRAGSV--- | ---DPE | 221 |
| Consensus | GGG------- | --GGGSNSPV | NV-S-SR--- | -V---G--PIW | KKAILGSD-E | 250 |

| | | | | | |
|---|---|---|---|---|---|
| Lead-cDNA-ID:12575172 | EVKRVGNEMY | RKGLFNEALK | LYDRAIALSP | TNAAYRSNRA | AALIGLSRIG | 278 |
| CeresGdna:1519981 | EVKRTGNEMY | KKGCFGEALG | LYDKAIALAP | GNAAYRSNRA | AALMGLGRVV | 271 |
| Consensus | EVKR-GNEMY | -KG-F-EAL- | LYD-AIAL-P | -NAAYRSNRA | AAL-GL-R-- | 300 |

| | | | | | |
|---|---|---|---|---|---|
| Lead-cDNA-ID:12575172 | EAVKECEDAV | RSDPNYGRAH | HRLALLLIRL | GQVNSARKHL | CFLGRPSDPM | 328 |
| CeresGdna:1519981 | EAVKECEEAV | RLDPNYWRAH | QRLGVLLIRL | GLVESARKHL | CFPGQHPDPV | 321 |
| Consensus | EAVKECE-AV | R-DPNY-RAH | -RL---LLIRL | G-V-SARKHL | CF-G---DP- | 350 |

Figure 113 (Continued)

| | | | | | | |
|---|---|---|---|---|---|---|
| Lead-cDNA-ID:12575172 | ELQKLEAVEK | HLIKCVDARR | VTDWKTVLIE | ADAAIVSGAD | FSPQLFMCKV | 378 |
| CeresGdna:1519981 | ELQKLQLVEK | HLSKCSDARK | VNDWNGTLRE | AEASIAAGAD | YCPQLFMCRA | 371 |
| Consensus | ELQKL--VEK | HL-KC-DAR- | V-DW----L-E | A-A-I---GAD | --PQLFMC--- | 400 |
| Lead-cDNA-ID:12575172 | EAFLKLHRLD | DAQSKLLEVP | KVEPFPVSCS | QTRFSGMACE | AYIYFVKAQI | 428 |
| CeresGdna:1519981 | EALLKLHQLE | DAESCLLKVP | KLEPH-ATCS | QARFFGMLSE | AYPFLVQAQI | 420 |
| Consensus | EA-LKLH-L- | DA-S-LL-VP | K-EP-P---CS | Q-RF-GM---E | AY----V-AQI | 450 |
| Lead-cDNA-ID:12575172 | EMALGRFENA | VMAAEKASQI | DPRCNEVAML | HNTVTLVARA | RARGNDLYKS | 478 |
| CeresGdna:1519981 | EMALGRFENA | VAAAEKAGQI | DSRNVEVAVL | LKNVRLVARA | RTRGNDLFKS | 470 |
| Consensus | EMALGRFENA | V-AAEKA-QI | D-R--EVA-L | ---V-LVARA | R-RGNDL--KS | 500 |
| Lead-cDNA-ID:12575172 | ERYTEASSAY | AEGLRLDPCN | AILYCNRAAC | WFKLGMWERS | EDCNQALRY | 528 |
| CeresGdna:1519981 | ERFTEACSAY | GEGLRLDPSN | SVLYCNRAAC | WFKLGSWERS | DDCNQALRI | 520 |
| Consensus | ER-TEA-SAY | -EGLRLDP-N | --LYCNRAAC | WFKLG-WERS | I--DCNQALR- | 550 |
| Lead-cDNA-ID:12575172 | QPSYTKPLLR | RAASNSKMER | WGAAVSDYEA | LIRELPHDKE | VAESLFHAQV | 578 |
| CeresGdna:1519981 | QPNYTKALLR | RAASNSKLER | WADAVRDYEV | LRRELPDDNG | VAESLFHAQV | 570 |
| Consensus | QP-YTK-LLR | RAASNSK-ER | W-AV-DYE-- | L-RELP-D--- | VAESLFHAQV | 600 |
| Lead-cDNA-ID:12575172 | ALKKSRGEEV | LNMEFGGEVE | EIYSLEQFKS | AMNLPG---- | --VSVIHFST | 622 |
| CeresGdna:1519981 | ALKKSRGEEV | YNMKFGGEVE | EVLGFEQFRA | AISLPGKSSL | SCVSVVHFKS | 620 |
| Consensus | ALKKSRGEEV | -NM-FGGEVE | E-----EQF-- | A--LPGKSSL | SCVSV--HF-- | 650 |
| Lead-cDNA-ID:12575172 | ASDHQCKQIS | PFVDSLCTRY | PSIHFLKVDI | DKCPSIGNAE | NVRVVPTVKI | 672 |
| CeresGdna:1519981 | SSNVHCKQIS | PFVDTLCGRY | PSINFLKVDV | EEHPAIANAE | DVRIVPTFKI | 670 |
| Consensus | -S---CKQIS | PFVD-LC-RY | PSI-FLKVD- | ----P-I-NAE | -VR-VPT-KI | 700 |

Figure 113 (Continued)

```
Lead-cDNA-ID:12575172    YKNGSRVKEI  VCPSKEVLEY  SVRHYSG    699
CeresGdna:1519981        YKNGNRVKEI  VCPSHDVLEH  SVRHYSF    697

Consensus                YKNG-RVKEI  VCPS--VLE-  SVRHYS-    727
```

Figure 114

[Sequence alignment figure showing multiple protein sequences aligned in four blocks, with sequences labeled: CeresClone:678505, CeresClone:372747, gi|54290426, gi|34912704, CeresClone:553394, Lead-cDNA-ID:12605556, CeresGdna:1455463, and Consensus. Position numbers shown at right: 38/41/48/48/42/34/37, 50; 79/84/96/98/80/76/78, 100; 115/117/129/148/109/112/107, 150; 165/167/179/198/159/162/157, 200.]

Figure 114 (Continued)

```
CeresClone:678505      SSRFLPSKDK  TTWAAKNVAD  CVLSDKSSLK  VTTTQRMAES  SVLDAHTADV  215
CeresClone:372747      NSRFLPSKDK  SSWDPKDVAD  CILSDRSTMK  VTTGQRMTES  SVLDAHVAEV  217
gi|54290426            NSRFPPSKDK  SKMDPKDVAD  WILAEKSSL-  VTTGQRMTES  SVLDAHSSDV  228
gi|34912704            NSRFPPSKDK  SKMDPKDVAD  WILAEKSSLK  VTTGQRMTES  SVLDAHSSDV  248
CeresClone:553394      NSSYIKSKDK  SKWTAKDVAD  SVLADRSSLR  VTSSQRLEES  SVLNTHSSEI  209
Lead-cDNA:ID:12605556  NSR-LTSKEK  KITWSAKEVAD SVLSDKSALR  VTSSQRLEES  SVLDAHASDI  211
CeresGdna:1455463      NLQFVKSKDK  NTWAAKDVAD  SVLSDKSSLR  VTSTQRLSES  SILDAHANEI  207

Consensus              NSRFLPSKDK  STW-AKDVAD  -VLSDKSSL-  VTT-QRM-ES  SVLDAHSSDV  250

CeresClone:678505      DGEPYWYYEY  LVRKSPTKSA  PEPNLFRHNV  ACTAERDGFL  YSLNASTLSK  265
CeresClone:372747      DGEPYWYYEY  LVRKSPTKSA  PEPNLFRHNV  ACTAERDGYL  YSLNASTLSK  267
gi|54290426            DGEPYWYYEY  LVRKSPTQSA  PEPNLFRHNV  ACTAERDGYL  YSLNASTLSK  278
gi|34912704            DGEPYWYYEY  LVRKSPTQSA  PEPNLFRHNV  ACTAERDGYL  YSLNASTLSK  298
CeresClone:553394      DGEMYWYYEY  LVRKAPLRLT  DESSTYRHYL  ASTAERDGYL  YSISASTVSF  259
Lead-cDNA:ID:12605556  DGEPYWYYEY  LVRKSPTKLA  EASKLYRHYL  SSTAERDGYL  YTINASTLGK  261
CeresGdna:1455463      DGEPYWFYEY  LVRKSPTKNA  QESNLFRRYL  ASTAERDGYL  YSLSASTLSK  257

Consensus              DGEPYWYYEY  LVRKSPTKSA  PEPNLFRHNV  ACTAERDGYL  YSLNASTLSK  300

CeresClone:678505      QWESMGPLLQ  KAVAS-----  ------FH--  LL----PPT  EKYVPPYQDP  297
CeresClone:372747      QWESMGPFLQ  KTVAS-----  ------FR--  LL----PGT  ENVPPPYKDP  299
gi|54290426            QWESMGPSLQ  KTVAS-----  ------FH--  LL----PPT  ENYVPPYQDP  310
gi|34912704            QWESKIMFLH  TRIHGDFGDI  AIRFLLLLFH  VLGDLGTSGF  RTYFPVMDAS  348
CeresClone:553394      LWEKLGPFLD  KAVNS-----  ------FR--  LL----SPT  ENYVPPYKDP  291
Lead-cDNA:ID:12605556  QWDKMGPVLE  RAVGS-----  ------FR--  LL----PPT  DSYVPPYKDP  293
CeresGdna:1455463      QWDKMGPYLE  KTVAS-----  ------FR--  LL----PPT  GDYVPPYKDP  289

Consensus              QWESMGPFL-  K-VAS-----  ------FR--  LL----PPT  ENYVPPYKDP  350

CeresClone:678505      WRFW------  --         301
CeresClone:372747      WRFW------  --         303
gi|54290426            WRFW------  --         314
gi|34912704            VMSALSVLQN  EA         360
CeresClone:553394      WRFW------  --         295
Lead-cDNA:ID:12605556  WRFW------  --         297
CeresGdna:1455463      WRFW------  --         293

Consensus              WRFW------  --         362
```

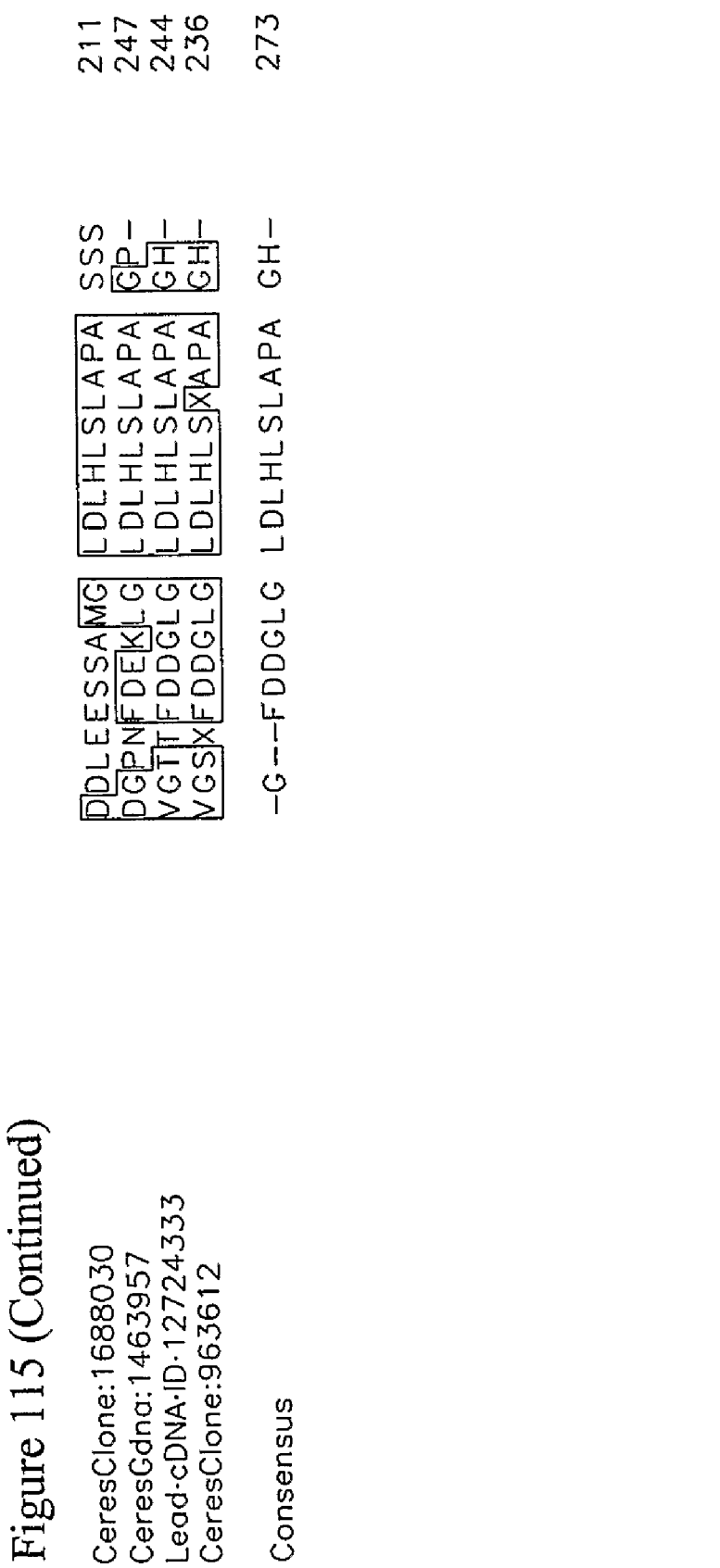

IDENTIFICATION OF TERPENOID-BIOSYNTHESIS RELATED REGULATORY PROTEIN-REGULATORY REGION ASSOCIATIONS

CROSS-REFERENCE TO RELATED APPLICATIONS

This application is a National Stage application under 35 U.S.C. §371 which claims the benefit of International Application No. PCT/US2006/022851 having an International Filing Date of Jun. 8, 2006, which claims priority under 35 U.S.C. §119 to U.S. Provisional Application No. 60/689,035, filed on Jun. 8, 2005, which is incorporated herein by reference in their entirety.

TECHNICAL FIELD

This document relates to materials and methods for identifying regulatory protein and regulatory region pairs, e.g., transcription factor-promoter pairs. This document also relates to materials and methods for using such associated pairs to modulate expression of nucleic acid sequences of interest, including both endogenous and exogenous nucleic acid sequences, such as those involved in terpenoid biosynthesis.

INCORPORATION-BY-REFERENCE & TEXTS

The material on the accompanying diskette is hereby incorporated by reference into this application. The accompanying compact discs are identical and contain one file, sequencelisting.txt, which was created on Jun. 8, 2006. The file named sequencelisting.txt is 2,142 KB. The file can be accessed using Microsoft Word on a computer that uses Windows OS.

BACKGROUND

Regulation of gene expression is achieved by the direct and/or indirect interaction of regulatory proteins such as transcription factors with cis-acting DNA regulatory regions, including promoters, promoter elements, and promoter motifs, which may be located upstream, downstream and/or within a gene of interest. Certain regulatory proteins can interact with regulatory regions for a number of genes, often driving the coordinate expression of multiple genes in a pathway. For example, binding of a transcription factor to a promoter or promoter element usually results in a modulation (e.g., an increase) of basal rates of transcription initiation and/or elongation. Promoters typically have a modular organization that includes multiple cis-elements (promoter elements), which can interact in additive or synergistic manners to modulate transcription, e.g., to result in constitutive or non-constitutive expression patterns. Non-constitutive expression patterns can include tissue-specific expression, developmental stage-specific expression, and environmental factor-specific expression.

Identification of regulatory proteins that bind to particular DNA regulatory regions can provide tools to facilitate the selective expression of proteins of interest, e.g., to modify plant biosynthetic pathways and/or to modify plant responses to environmental stress and disease conditions.

SUMMARY

The present invention relates to materials and methods for modulating expression of nucleic acid sequences, such as those encoding polypeptides involved in biosynthesis of terpenoids. For example, the invention relates to the identification of regulatory proteins that are associated with regulatory regions, i.e., regulatory proteins that are capable of interacting either directly or indirectly with regulatory regions of genes encoding enzymes in a terpenoid biosynthesis pathway, and thereby modulating expression, e.g., transcription, of such genes. Modulation of expression can include up-regulation or activation, e.g., an increase of expression relative to basal or native states, e.g., a control level. In other cases, modulation of expression can include down-regulation or repression, e.g., a decrease of expression relative to basal or native states, such as the level in a control. In many cases, a regulatory protein is a transcription factor and its associated regulatory region is a promoter. Regulatory proteins identified as being capable of interacting directly or indirectly with regulatory regions of genes encoding enzymes in a terpenoid biosynthesis pathway can be used to create transgenic plants, e.g., plants capable of producing one or more terpenoids. Such plants can have modulated, e.g., increased, amounts and/or rates of biosynthesis of one or more terpenoid compounds. Regulatory proteins can also be used along with their cognate promoters to modulate transcription of one or more endogenous sequences, e.g., terpenoid biosynthesis genes, in a plant cell. Given the variety of uses of the various terpenoid classes of compounds, it would be useful to control selective expression of one or more proteins, including enzymes, regulatory proteins, and other auxiliary proteins, involved in terpenoid biosynthesis, e.g., to regulate biosynthesis of known and/or novel terpenoids.

Unless otherwise defined, all technical and scientific terms used herein have the same meaning as commonly understood by one of ordinary skill in the art to which this invention pertains. Although methods and materials similar or equivalent to those described herein can be used to practice the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

The details of one or more embodiments of the invention are set forth in the accompanying drawings and the description below. Other features, objects, and advantages of the invention will be apparent from the description and drawings, and from the claims.

DESCRIPTION OF THE DRAWINGS

FIG. 2 is an alignment of the amino acid sequence of Lead CDNA ID 23492765 (SEQ ID NO:14) with homologous and/or orthologous amino acid sequences CeresClone:381106 (SEQ ID NO:15), gi|55297106 (SEQ ID NO:16), and gi|34911652 (SEQ ID NO:17). The consensus sequence determined by the alignment is set forth.

FIG. 3 is an alignment of the amino acid sequence of Lead CDNA ID 23495742 (SEQ ID NO:19) with homologous and/or orthologous amino acid sequence CeresClone:681294 (SEQ ID NO:20). The consensus sequence determined by the alignment is set forth.

FIG. 6 is an alignment of the amino acid sequence of Lead CDNA ID 23500996 (SEQ ID NO:36) with homologous and/or orthologous amino acid sequence CeresClone:545208 (SEQ ID NO:37). The consensus sequence determined by the alignment is set forth.

FIG. 7 is an alignment of the amino acid sequence of Lead CDNA ID 23515088 (SEQ ID NO:47) with homologous and/or orthologous amino acid sequences gi|861091 (SEQ ID NO:48) and gi|2346972 (SEQ ID NO:49). The consensus sequence determined by the alignment is set forth.

FIG. 8 is an alignment of the amino acid sequence of Lead CDNA ID 23522373 (SEQ ID NO:53) with homologous and/or orthologous amino acid sequences gi|3608135 (SEQ ID NO:54), CeresClone:1188156 (SEQ ID NO:55), and gi|42570366 (SEQ ID NO:56). The consensus sequence determined by the alignment is set forth.

FIG. 9 is an alignment of the amino acid sequence of Lead cDNA ID 23529806 (SEQ ID NO:58) with homologous and/or orthologous amino acid sequences gi|21593788 (SEQ ID NO:59), CeresClone:969293 (SEQ ID NO:60), CeresClone:852336 (SEQ ID NO:61), CeresClone:234649 (SEQ ID NO:62), CeresClone:460881 (SEQ ID NO:63), and gi|50939745 (SEQ ID NO:64). The consensus sequence determined by the alignment is set forth.

FIG. 10 is an alignment of the amino acid sequence of Lead CDNA ID 23530574 (SEQ ID NO:66) with homologous and/or orthologous amino acid sequence gi|7486367 (SEQ ID NO:67). The consensus sequence determined by the alignment is set forth.

FIG. 11 is an alignment of the amino acid sequence of Lead CDNA ID 23544687 (SEQ ID NO:73) with homologous and/or orthologous amino acid sequence CeresClone:474183 (SEQ ID NO:74). The consensus sequence determined by the alignment is set forth.

FIG. 12 is an alignment of the amino acid sequence of Lead CDNA ID 23557940 (SEQ ID NO:80) with homologous and/or orthologous amino acid sequences CeresClone:475730 (SEQ ID NO:81) and CeresClone:1534270 (SEQ ID NO:82). The consensus sequence determined by the alignment is set forth.

FIG. 13 is an alignment of the amino acid sequence of Lead CDNA ID 23653450 (SEQ ID NO:88) with homologous and/or orthologous amino acid sequences CeresClone:918824 (SEQ ID NO:89) and gi|50938747 (SEQ ID NO:90). The consensus sequence determined by the alignment is set forth.

FIG. 14 is an alignment of the amino acid sequence of Lead CDNA ID 24374230 (SEQ ID NO:92) with homologous and/or orthologous amino acid sequences CeresClone:1507510 (SEQ ID NO:93), CeresClone:500887 (SEQ ID NO:94), and gi|50931081 (SEQ ID NO:95). The consensus sequence determined by the alignment is set forth.

FIG. 16 is an alignment of the amino acid sequence of Lead CeresClone 10375 (SEQ ID NO:108) homologous and/or orthologous amino acid sequences gi|30577630 (SEQ ID NO:109), CeresClone:538817 (SEQ ID NO:110), and gi|183866 (SEQ ID NO:111). The consensus sequence determined by the alignment is set forth.

FIG. 17 is an alignment of the amino acid sequence of Lead CeresClone 108509 (SEQ ID NO:115) with homologous and/or orthologous amino acid sequences CeresClone:764678 (SEQ ID NO:116) and CeresClone:333416 (SEQ ID NO:117). The consensus sequence determined by the alignment is set forth.

FIG. 18 is an alignment of the amino acid sequence of Lead CeresClone 11130 (SEQ ID NO:119) with homologous and/or orthologous amino acid sequences gi|11994583 (SEQ ID NO:120), CeresClone:592400 (SEQ ID NO:121), and gi|50900102 (SEQ ID NO:122). The consensus sequence determined by the alignment is set forth.

FIG. 19 is an alignment of the amino acid sequence of Lead CeresClone 115924 (SEQ ID NO:124) with homologous and/or orthologous amino acid sequences CeresClone:477003 (SEQ ID NO:125), CeresClone:894637 (SEQ ID NO:126), and gi|50725048 (SEQ ID NO:127). The consensus sequence determined by the alignment is set forth.

FIG. 20 is an alignment of the amino acid sequence of Lead CeresClone 117089 (SEQ ID NO:131) with homologous and/or orthologous amino acid sequences gi|50907243 (SEQ ID NO:132), CeresClone:478779 (SEQ ID NO:133), and CeresClone:634320 (SEQ ID NO:134). The consensus sequence determined by the alignment is set forth.

FIG. 21 is an alignment of the amino acid sequence of Lead CeresClone 119104 (SEQ ID NO:136) with homologous and/or orthologous amino acid sequences CeresClone:337006 (SEQ ID NO:137), CeresClone:220709 (SEQ ID NO:138), and gi|53792087 (SEQ ID NO:139). The consensus sequence determined by the alignment is set forth.

FIG. 22 is an alignment of the amino acid sequence of Lead CeresClone 120947 (SEQ ID NO:141) with homologous and/or orthologous amino acid sequence gi|9759231 (SEQ ID NO:142). The consensus sequence determined by the alignment is set forth.

FIG. 24 is an alignment of the amino acid sequence of Lead CeresClone 12997 (SEQ ID NO:151) with homologous and/or orthologous amino acid sequence CeresClone:465893 (SEQ ID NO:152). The consensus sequence determined by the alignment is set forth.

FIG. 25 is an alignment of the amino acid sequence of Lead CeresClone 14234 (SEQ ID NO:158) with homologous and/or orthologous amino acid sequences CeresClone:567499 (SEQ ID NO:159), CeresClone:361163 (SEQ ID NO:160), and gi 50912455 (SEQ ID NO:161). The consensus sequence determined by the alignment is set forth.

FIG. 26 is an alignment of the amino acid sequence of Lead CeresClone 14246 (SEQ ID NO:163) with homologous and/or orthologous amino acid sequences CeresClone:511197 (SEQ ID NO:164), gi|311952 (SEQ ID NO:165), gi|20005 (SEQ ID NO:166), CeresClone:1537388 (SEQ ID NO:167), gi|50934311 (SEQ ID NO:168), and gi|3550485 (SEQ ID NO:169). The consensus sequence determined by the alignment is set forth.

FIG. 27 is an alignment of the amino acid sequence of Lead CeresClone 154718 (SEQ ID NO:173) with homologous and/or orthologous amino acid sequences gi|2832408 (SEQ ID NO:174) and gi|50872446 (SEQ ID NO:175). The consensus sequence determined by the alignment is set forth.

FIG. 29 is an alignment of the amino acid sequence of Lead CeresClone 17632 (SEQ ID NO:192) with homologous and/or orthologous amino acid sequences gi|9294110 (SEQ ID NO:193), CeresClone:975540 (SEQ ID NO:194), CeresClone:473410 (SEQ ID NO:195), CeresClone:703717 (SEQ ID NO:196), CeresClone:1459706 (SEQ ID NO:197), and gi|50905911 (SEQ ID NO:198). The consensus sequence determined by the alignment is set forth.

FIG. 30 is an alignment of the amino acid sequence of Lead CeresClone 19340 (SEQ ID NO:200) with homologous and/or orthologous amino acid sequences CeresClone:573293 (SEQ ID NO:201), CeresClone:537080 (SEQ ID NO:202), gi|50919203 (SEQ ID NO:203), and CeresClone:230342 (SEQ ID NO:204). The consensus sequence determined by the alignment is set forth.

FIG. 32 is an alignment of the amino acid sequence of Lead CeresClone 207629 (SEQ ID NO:210) with homologous and/or orthologous amino acid sequences CeresClone:118184 (SEQ ID NO:211), CeresClone:1006473 (SEQ ID NO:212), CeresClone:24667 (SEQ ID NO:213), CeresClone:12459 (SEQ ID NO:214), CeresClone:1354021 (SEQ ID NO:215), and CeresClone:3244 (SEQ ID NO:216). The consensus sequence determined by the alignment is set forth.

FIG. 33 is an alignment of the amino acid sequence of Lead CeresClone 20769 (SEQ ID NO:218) with homologous and/or orthologous amino acid sequences CeresClone:477718 (SEQ ID NO:219) and CeresClone:518521 (SEQ ID NO:220). The consensus sequence determined by the alignment is set forth.

FIG. 34 is an alignment of the amino acid sequence of Lead CeresClone 208303 (SEQ ID NO:222) with homologous and/or orthologous amino acid sequences CeresClone:25793 (SEQ ID NO:223), CeresClone:1100893 (SEQ ID NO:224), gi|41529318 (SEQ ID NO:225), CeresClone:1052135 (SEQ ID NO:226), and gi|50726325 (SEQ ID NO:227). The consensus sequence determined by the alignment is set forth.

FIG. 35 is an alignment of the amino acid sequence of Lead CeresClone 21075 (SEQ ID NO:229) with homologous and/or orthologous amino acid sequences gi|14030607 (SEQ ID NO:230), gi|5107082 (SEQ ID NO:231), CeresClone:392743 (SEQ ID NO:232), CeresClone:1090803 (SEQ ID NO:233), CeresClone:946808 (SEQ ID NO:234), CeresClone:1086365 (SEQ ID NO:235), CeresClone:373100 (SEQ ID NO:236), CeresClone:1323425 (SEQ ID NO:237), CeresClone:617980 (SEQ ID NO:238), gi|50251897 (SEQ ID NO:239), gi|5107149 (SEQ ID NO:240), gi|50928231 (SEQ ID NO:241), CeresClone:714267 (SEQ ID NO:242), and CeresClone:584348 (SEQ ID NO:243). The consensus sequence determined by the alignment is set forth.

FIG. 37 is an alignment of the amino acid sequence of Lead CeresClone 222894 (SEQ ID NO:249) with homologous and/or orthologous amino acid sequences gi|39545932 (SEQ ID NO:250) and CeresClone:1168684 (SEQ ID NO:251). The consensus sequence determined by the alignment is set forth.

FIG. 38 is an alignment of the amino acid sequence of Lead CeresClone 22339 (SEQ ID NO:253) with homologous and/or orthologous amino acid sequences gi|52548134 (SEQ ID NO:254), gi|52548152 (SEQ ID NO:255), CeresClone:103400 (SEQ ID NO:256), gi|17223670 (SEQ ID NO:257), gi|16973296 (SEQ ID NO:258), gi|33308109 (SEQ ID NO:259), CeresClone:1043518 (SEQ ID NO:260), CeresClone:1046745 (SEQ ID NO:261), gi|62132641 (SEQ ID NO:262), gi|14279306 (SEQ ID NO:263), and gi|52548104 (SEQ ID NO:264). The consensus sequence determined by the alignment is set forth.

FIG. 40 is an alignment of the amino acid sequence of Lead CeresClone 232985 (SEQ ID NO:277) with homologous and/or orthologous amino acid sequences CeresClone:304618 (SEQ ID NO:278) and gi|34898016 (SEQ ID NO:279). The consensus sequence determined by the alignment is set forth.

FIG. 42 is an alignment of the amino acid sequence of Lead CeresClone 25795 (SEQ ID NO:291) with homologous and/or orthologous amino acid sequence CeresClone:1104601 (SEQ ID NO:292). The consensus sequence determined by the alignment is set forth.

FIG. 43 is an alignment of the amino acid sequence of Lead CeresClone 272716 (SEQ ID NO:298) with homologous and/or orthologous amino acid sequences CeresClone:678281 (SEQ ID NO:299) and gi|54287657 (SEQ ID NO:300). The consensus sequence determined by the alignment is set forth.

FIG. 44 is an alignment of the amino acid sequence of Lead CeresClone 27793 (SEQ ID NO:302) with homologous and/or orthologous amino acid sequence CeresClone:522644 (SEQ ID NO:303). The consensus sequence determined by the alignment is set forth.

FIG. 45 is an alignment of the amino acid sequence of Lead CeresClone 283597 (SEQ ID NO:305) with homologous and/or orthologous amino acid sequences CeresClone:40501

(SEQ ID NO:306) and CeresClone:407007 (SEQ ID NO:307). The consensus sequence determined by the alignment is set forth.

FIG. 46 is an alignment of the amino acid sequence of Lead CeresClone 286402 (SEQ ID NO:309) with homologous and/or orthologous amino acid sequence CeresClone:23276 (SEQ ID NO:310). The consensus sequence determined by the alignment is set forth.

FIG. 47 is an alignment of the amino acid sequence of Lead CeresClone 29310 (SEQ ID NO:312) with homologous and/or orthologous amino acid sequences CeresClone:3997 (SEQ ID NO:313), gi|19697 (SEQ ID NO:314), gi|2119938 (SEQ ID NO:315), gi|485943 (SEQ ID NO:316), and gi|38564733 (SEQ ID NO:317). The consensus sequence determined by the alignment is set forth.

FIG. 48 is an alignment of the amino acid sequence of Lead CeresClone 29637 (SEQ ID NO:319) with homologous and/or orthologous amino acid sequence gi|34896798 (SEQ ID NO:320). The consensus sequence determined by the alignment is set forth.

FIG. 49 is an alignment of the amino acid sequence of Lead CeresClone 304523 (SEQ ID NO:324) with homologous and/or orthologous amino acid sequences CeresClone:481452 (SEQ ID NO:325) and gi|52353366 (SEQ ID NO:326). The consensus sequence determined by the alignment is set forth.

FIG. 50 is an alignment of the amino acid sequence of Lead CeresClone 306497 (SEQ ID NO:328) with homologous and/or orthologous amino acid sequence gi|50944571 (SEQ ID NO:329). The consensus sequence determined by the alignment is set forth.

FIG. 51 is an alignment of the amino acid sequence of Lead CeresClone 31894 (SEQ ID NO:335) with homologous and/or orthologous amino acid sequences CeresClone:470947 (SEQ ID NO:336), CeresClone:1362529 (SEQ ID NO:337), CeresClone:696259 (SEQ ID NO:338), and CeresClone:425645 (SEQ ID NO:339). The consensus sequence determined by the alignment is set forth.

FIG. 52 is an alignment of the amino acid sequence of Lead CeresClone 319760 (SEQ ID NO:341) with homologous and/or orthologous amino acid sequence CeresClone:819279 (SEQ ID NO:342). The consensus sequence determined by the alignment is set forth.

FIG. 53 is an alignment of the amino acid sequence of Lead CeresClone 325565 (SEQ ID NO:344) with homologous and/or orthologous amino acid sequences gi|50934701 (SEQ ID NO:345), gi|20269063 (SEQ ID NO:346), and gi|7442240 (SEQ ID NO:347). The consensus sequence determined by the alignment is set forth.

Figure 54:
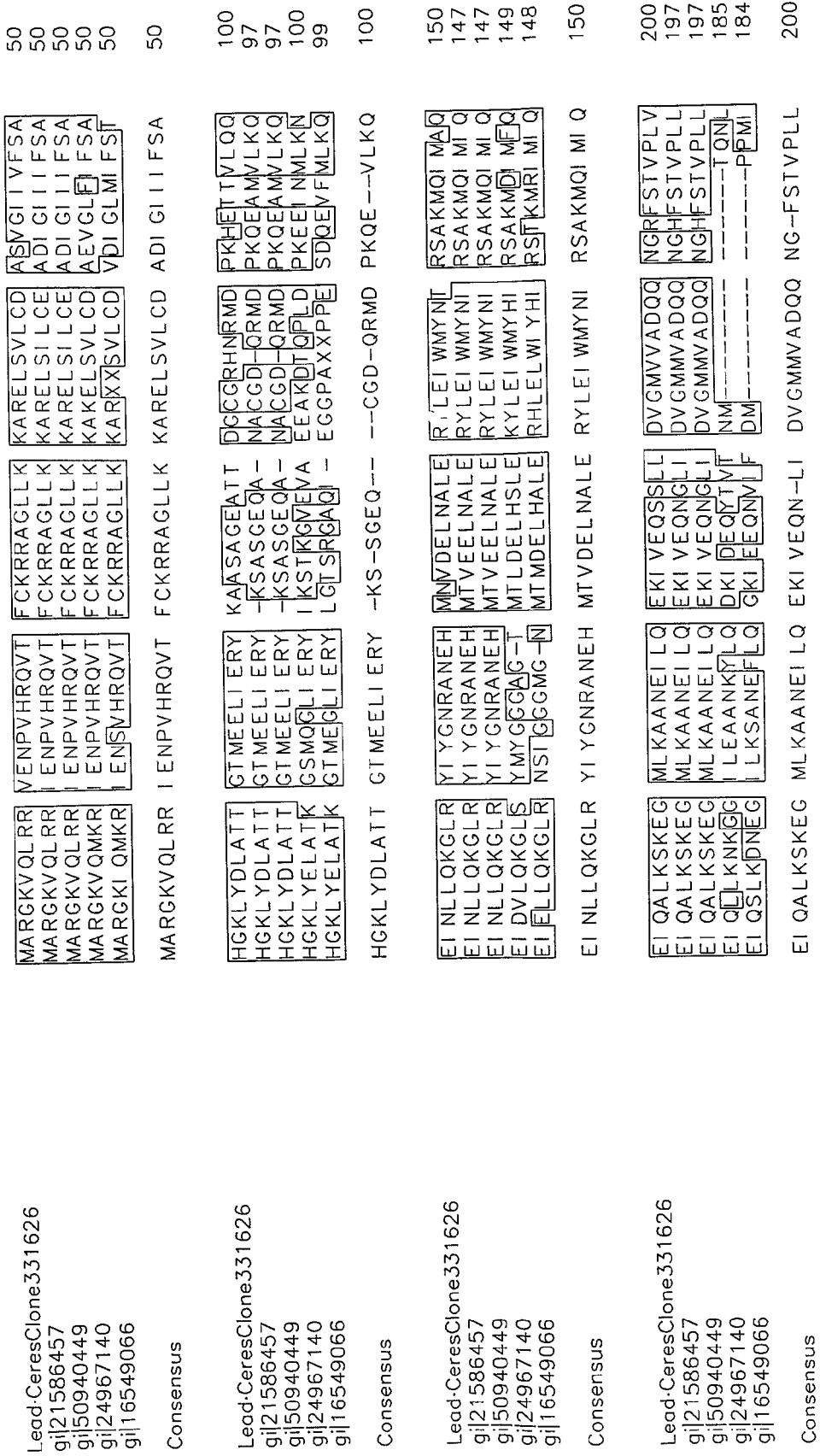
Figure 54:
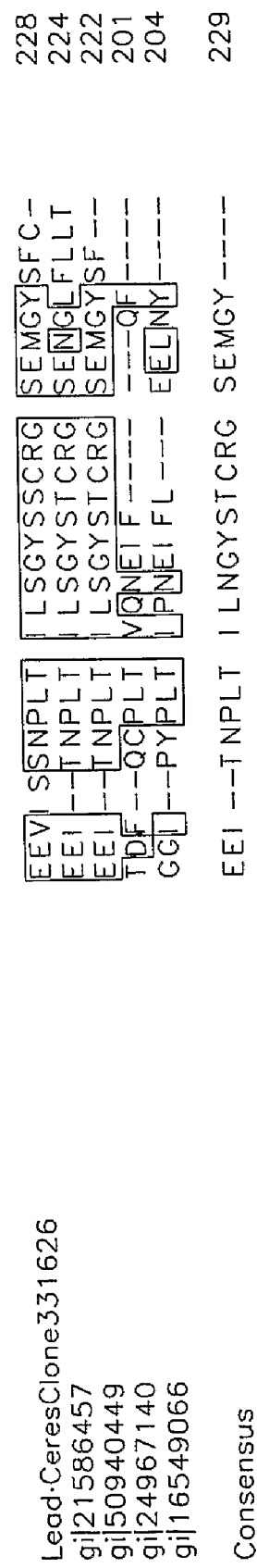

FIG. 54 is an alignment of the amino acid sequence of Lead CeresClone 331626 (SEQ ID NO:349) with homologous and/or orthologous amino acid sequences gi|24967140 (SEQ ID NO:350), gi|21586457 (SEQ ID NO:351), gi|50940449 (SEQ ID NO:352), and gi|16549066 (SEQ ID NO:353). The consensus sequence determined by the alignment is set forth.

FIG. 55 is an alignment of the amino acid sequence of Lead CeresClone 333416 (SEQ ID NO:355) with homologous and/or orthologous amino acid sequences CeresClone:108509 (SEQ ID NO:356) and CeresClone:764678 (SEQ ID NO:357). The consensus sequence determined by the alignment is set forth.

Figure 56:
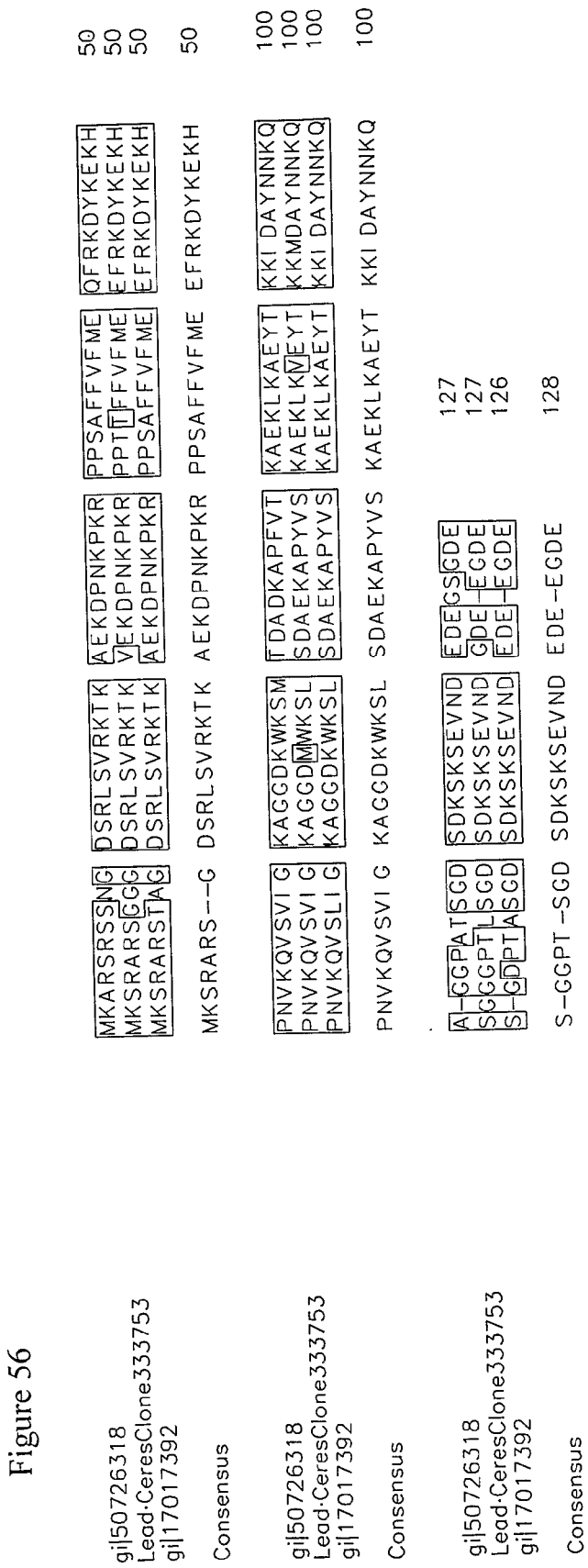

FIG. 56 is an alignment of the amino acid sequence of Lead CeresClone 333753 (SEQ ID NO:359) with homologous and/or orthologous amino acid sequences gi|17017392 (SEQ ID NO:360) and gi|50726318 (SEQ ID NO:361). The consensus sequence determined by the alignment is set forth.

Figure 57:
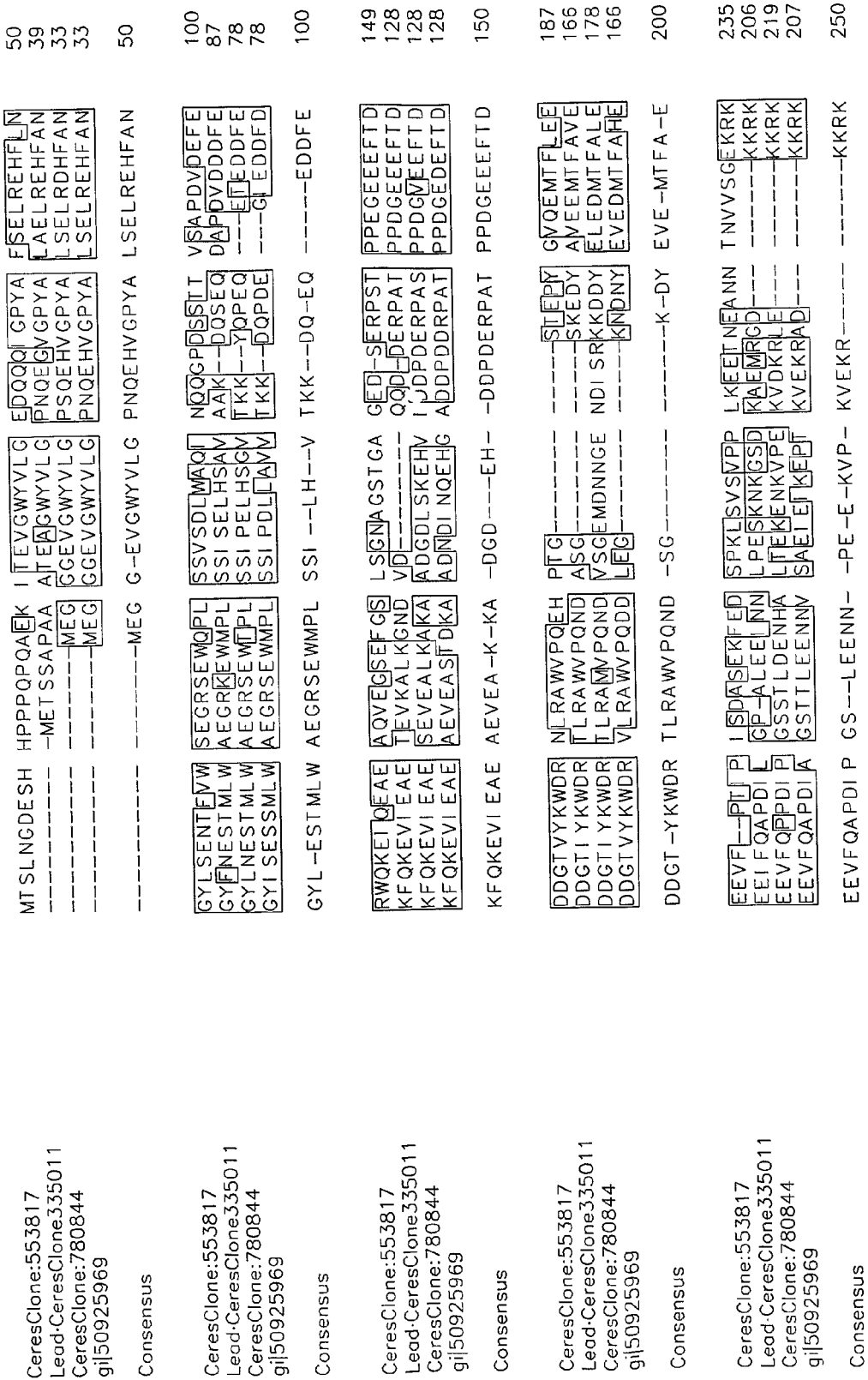

FIG. 57 is an alignment of the amino acid sequence of Lead CeresClone 335011 (SEQ ID NO:363) with homologous and/or orthologous amino acid sequences CeresClone:553817 (SEQ ID NO:364), CeresClone:780844 (SEQ ID NO:365), and gi|50925969 (SEQ ID NO:366). The consensus sequence determined by the alignment is set forth.

FIG. 58 is an alignment of the amino acid sequence of Lead CeresClone 335471 (SEQ ID NO:368) with homologous and/or orthologous amino acid sequences CeresClone:226047 (SEQ ID NO:369), gi|33589800 (SEQ ID NO:370), CeresClone:1044196 (SEQ ID NO:371), and CeresClone:471303 (SEQ ID NO:372). The consensus sequence determined by the alignment is set forth.

FIG. 59 is an alignment of the amino acid sequence of Lead CeresClone 336323 (SEQ ID NO:374) with homologous and/or orthologous amino acid sequences CeresClone:106887 (SEQ ID NO:375), gi|21618231 (SEQ ID NO:376), gi|8493589 (SEQ ID NO:377), CeresClone:1076901 (SEQ ID NO:378), gi|453949 (SEQ ID NO:379), CeresClone:52899 (SEQ ID NO:380), CeresClone:298091 (SEQ ID NO:381), and gi|14149141 (SEQ ID NO:382). The consensus sequence determined by the alignment is set forth.

FIG. 60 is an alignment of the amino acid sequence of Lead CeresClone 336524 (SEQ ID NO:384) with homologous and/or orthologous amino acid sequences CeresClone:4734 (SEQ ID NO:385), CeresClone:951040 (SEQ ID NO:386), CeresClone:560681 (SEQ ID NO:387), CeresClone:280170 (SEQ ID NO:388), and gi|31431968 (SEQ ID NO:389). The consensus sequence determined by the alignment is set forth.

FIG. 61 is an alignment of the amino acid sequence of Lead CeresClone 336888 (SEQ ID NO:391) with homologous and/or orthologous amino acid sequence gi|46931308 (SEQ ID NO:392). The consensus sequence determined by the alignment is set forth.

FIG. 62 is an alignment of the amino acid sequence of Lead CeresClone 34060 (SEQ ID NO:394) with homologous and/or orthologous amino acid sequence CeresClone:810464 (SEQ ID NO:395). The consensus sequence determined by the alignment is set forth.

FIG. 63 is an alignment of the amino acid sequence of Lead CeresClone 34406 (SEQ ID NO:399) with homologous and/or orthologous amino acid sequences gi|12323160 (SEQ ID NO:400) and CeresClone:1604448 (SEQ ID NO:401). The consensus sequence determined by the alignment is set forth.

FIG. 64 is an alignment of the amino acid sequence of Lead CeresClone 35429 (SEQ ID NO:405) with homologous and/or orthologous amino acid sequence CeresClone:539578 (SEQ ID NO:406). The consensus sequence determined by the alignment is set forth.

FIG. 65 is an alignment of the amino acid sequence of Lead CeresClone 35786 (SEQ ID NO:408) with homologous and/or orthologous amino acid sequences CeresClone:288714 (SEQ ID NO:409) and gi|50904559 (SEQ ID NO:410). The consensus sequence determined by the alignment is set forth.

FIG. 66 is an alignment of the amino acid sequence of Lead CeresClone 362309 (SEQ ID NO:412) with homologous and/or orthologous amino acid sequences CeresClone:887276 (SEQ ID NO:413) and gi|51091016 (SEQ ID NO:414). The consensus sequence determined by the alignment is set forth.

Figure 67:
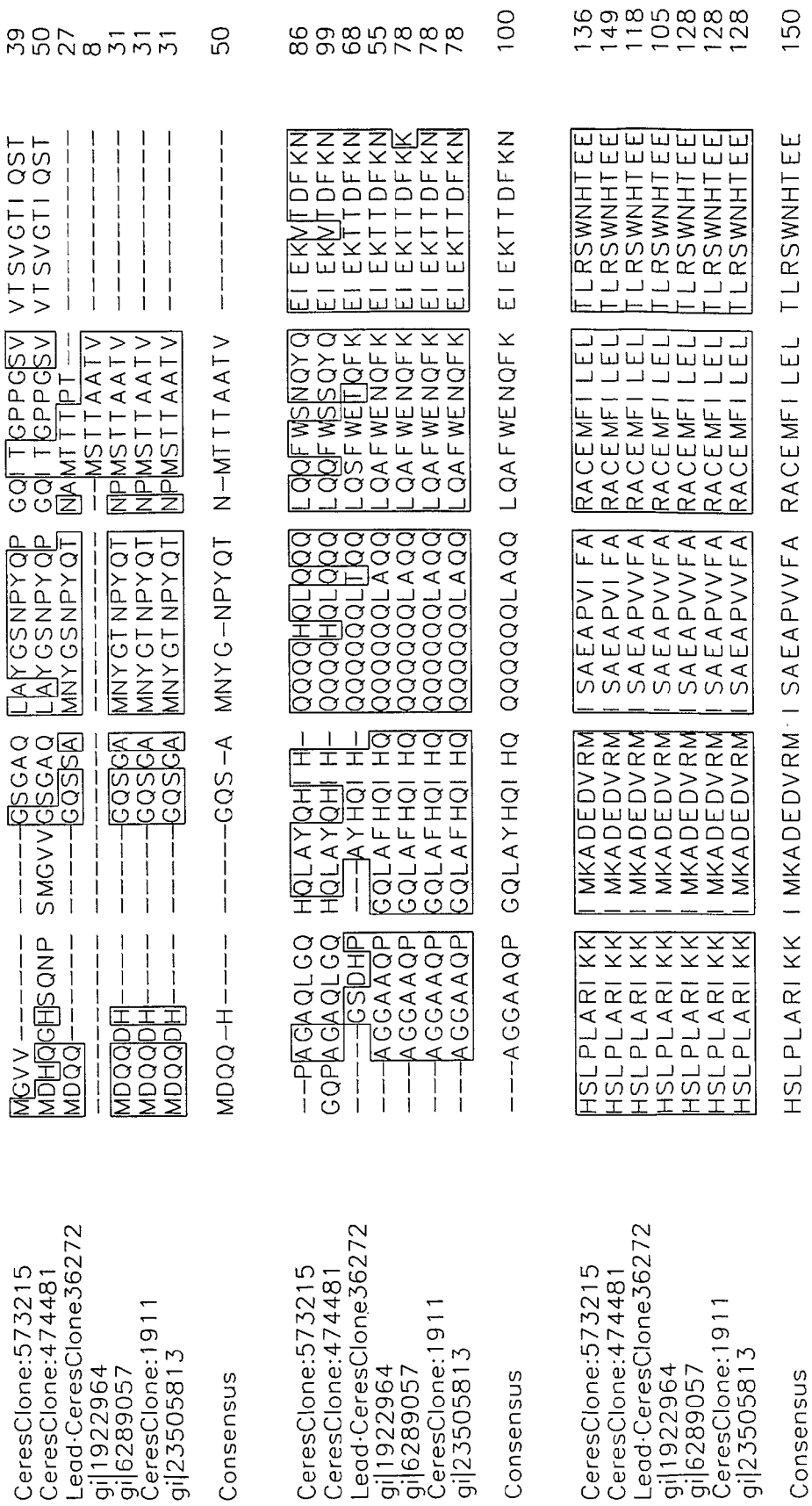

FIG. 67 is an alignment of the amino acid sequence of Lead CeresClone 36272 (SEQ ID NO:416) with homologous and/or orthologous amino acid sequences CeresClone:1911 (SEQ ID NO:417), gi|23505813 (SEQ ID NO:418), gi|6289057 (SEQ ID NO:419), gi|1922964 (SEQ ID NO:420), CeresClone:573215 (SEQ ID NO:421), and CeresClone:474481 (SEQ ID NO:422). The consensus sequence determined by the alignment is set forth.

FIG. 68 is an alignment of the amino acid sequence of Lead CeresClone 36927 (SEQ ID NO:424) with homologous and/ or orthologous amino acid sequence gi|37572445 (SEQ ID NO:425). The consensus sequence determined by the alignment is set forth.

FIG. 69 is an alignment of the amino acid sequence of Lead CeresClone 374674 (SEQ ID NO:427) with homologous and/or orthologous amino acid sequences gi|10177733 (SEQ ID NO:428), CeresClone:18612 (SEQ ID NO:429), and CeresClone:1359803 (SEQ ID NO:430). The consensus sequence determined by the alignment is set forth.

Figure 70:
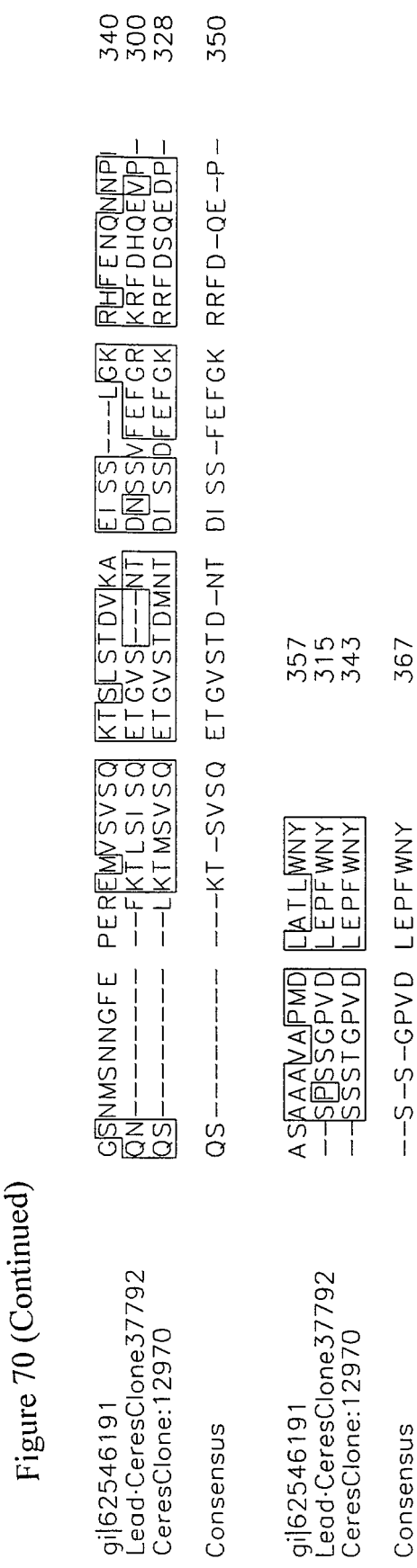

FIG. 70 is an alignment of the amino acid sequence of Lead CeresClone 37792 (SEQ ID NO:432) with homologous and/or orthologous amino acid sequences CeresClone:12970 (SEQ ID NO:433) and gi|62546191 (SEQ ID NO:434). The consensus sequence determined by the alignment is set forth.

FIG. 71 is an alignment of the amino acid sequence of Lead CeresClone 38311 (SEQ ID NO:436) with homologous and/or orthologous amino acid sequences CeresClone:19561 (SEQ ID NO:437), CeresClone:597624 (SEQ ID NO:438), gi|33320073 (SEQ ID NO:439), CeresClone:705041 (SEQ ID NO:440), CeresClone:331400 (SEQ ID NO:441), and gi|50932645 (SEQ ID NO:442). The consensus sequence determined by the alignment is set forth.

FIG. 72 is an alignment of the amino acid sequence of Lead CeresClone 38950 (SEQ ID NO:446) with homologous and/or orthologous amino acid sequences CeresClone:2657 (SEQ ID NO:447), gi|18481632 (SEQ ID NO:448), and CeresClone:749427 (SEQ ID NO:449). The consensus sequence determined by the alignment is set forth.

Figure 73:
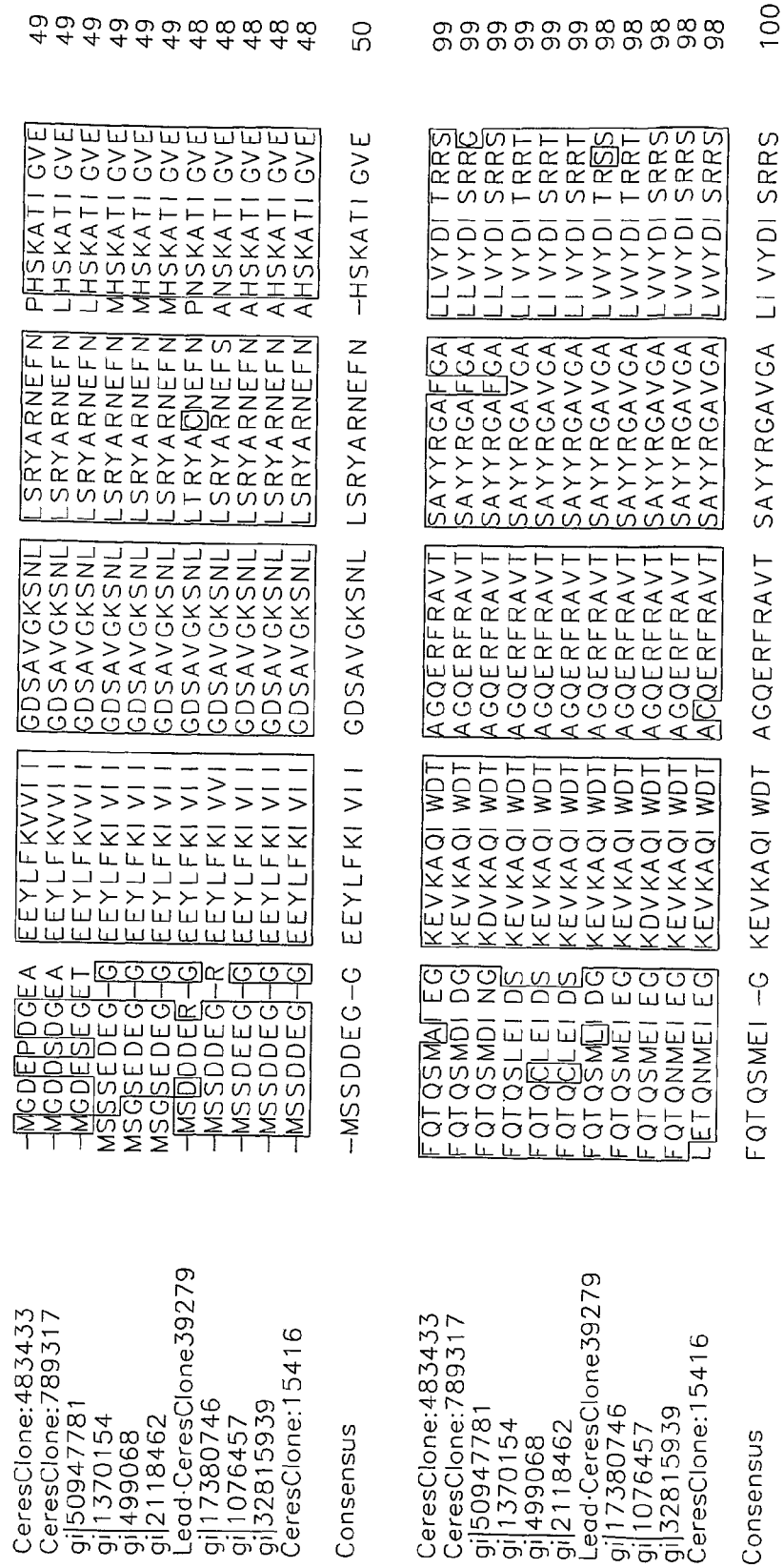

FIG. 73 is an alignment of the amino acid sequence of Lead CeresClone 39279 (SEQ ID NO:453) with homologous and/or orthologous amino acid sequences gi|32815939 (SEQ ID NO:454), gi|17380746 (SEQ ID NO:455), CeresClone:15416 (SEQ ID NO:456), gi|1076457 (SEQ ID NO:457), gi|499068 (SEQ ID NO:458), gi|2118462 (SEQ ID NO:459), CeresClone:789317 (SEQ ID NO:460), CeresClone:483433 (SEQ ID NO:461), gi|1370154 (SEQ ID NO:462), and gi|50947781 (SEQ ID NO:463). The consensus sequence determined by the alignment is set forth.

FIG. 74 is an alignment of the amino acid sequence of Lead CeresClone 3997 (SEQ ID NO:467) with homologous and/or orthologous amino acid sequences CeresClone:30700 (SEQ ID NO:468), gi|19698881 (SEQ ID NO:469), gi|19697 (SEQ ID NO:470), gi|2119938 (SEQ ID NO:471), gi|485943 (SEQ ID NO:472), gi|2119932 (SEQ ID NO:473), and gi|53792733 (SEQ ID NO:474). The consensus sequence determined by the alignment is set forth.

FIG. 75 is an alignment of the amino acid sequence of Lead CeresClone 39985 (SEQ ID NO:476) with homologous and/or orthologous amino acid sequences CeresClone:20104 (SEQ ID NO:477), CeresClone:207629 (SEQ ID NO:478), gi|20197615 (SEQ ID NO:479), CeresClone:105261 (SEQ ID NO:480), and gi|21536606 (SEQ ID NO:481). The consensus sequence determined by the alignment is set forth.

FIG. 76 is an alignment of the amino acid sequence of Lead CeresClone 40736 (SEQ ID NO:483) with homologous and/or orthologous amino acid sequences gi|20127109 (SEQ ID NO:484), CeresClone:590996 (SEQ ID NO:485), and CeresClone:631135 (SEQ ID NO:486). The consensus sequence determined by the alignment is set forth.

FIG. 77 is an alignment of the amino acid sequence of Lead CeresClone 42713 (SEQ ID NO:488) with homologous and/or orthologous amino acid sequences gi|21700803 (SEQ ID NO:489), gi|3641312 (SEQ ID NO:490), CeresClone:529894 (SEQ ID NO:491), gi|3320379 (SEQ ID NO:492), gi|12002865 (SEQ ID NO:493), and gi|50929277 (SEQ ID NO:494). The consensus sequence determined by the alignment is set forth.

Figure 78:
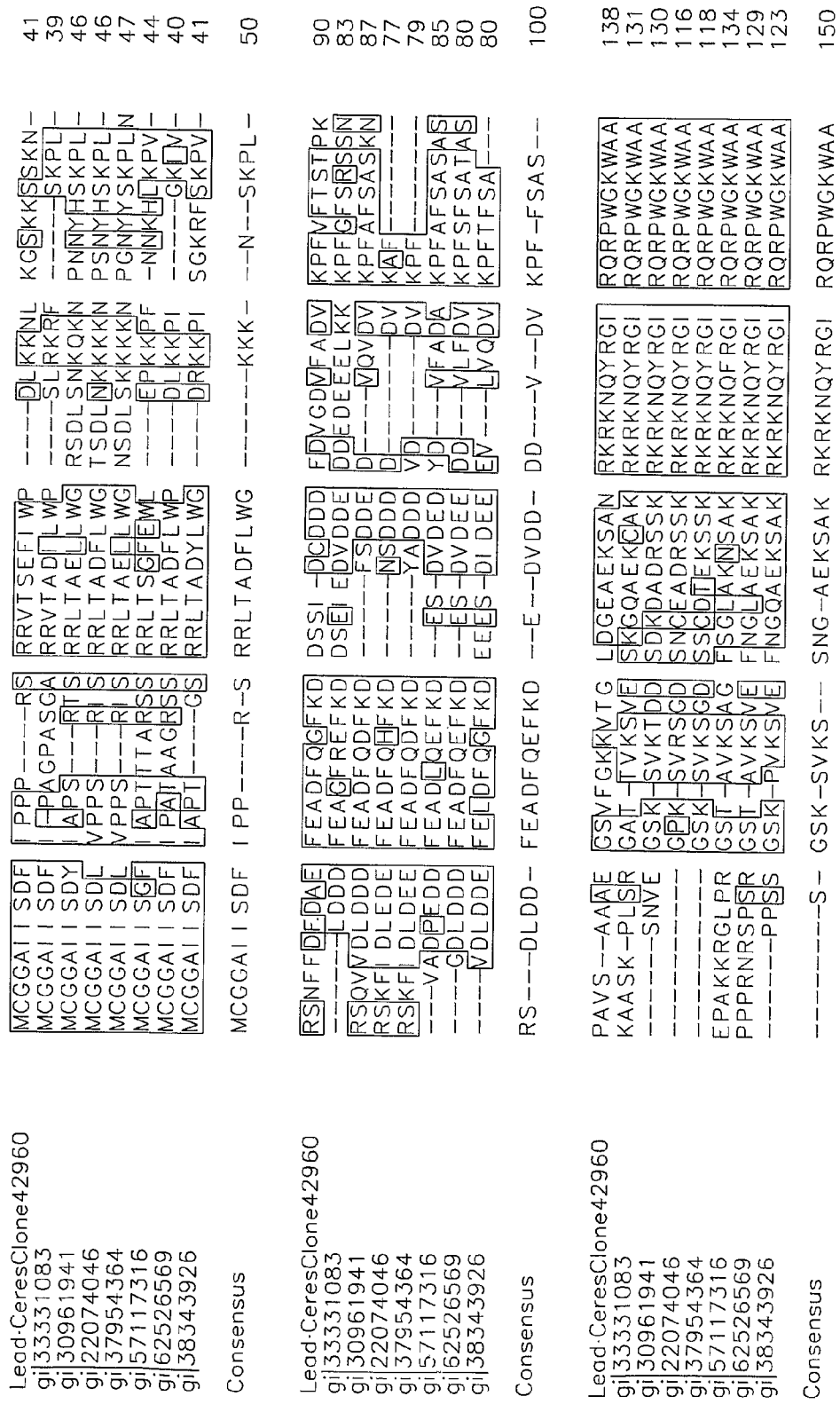
Figure 78:
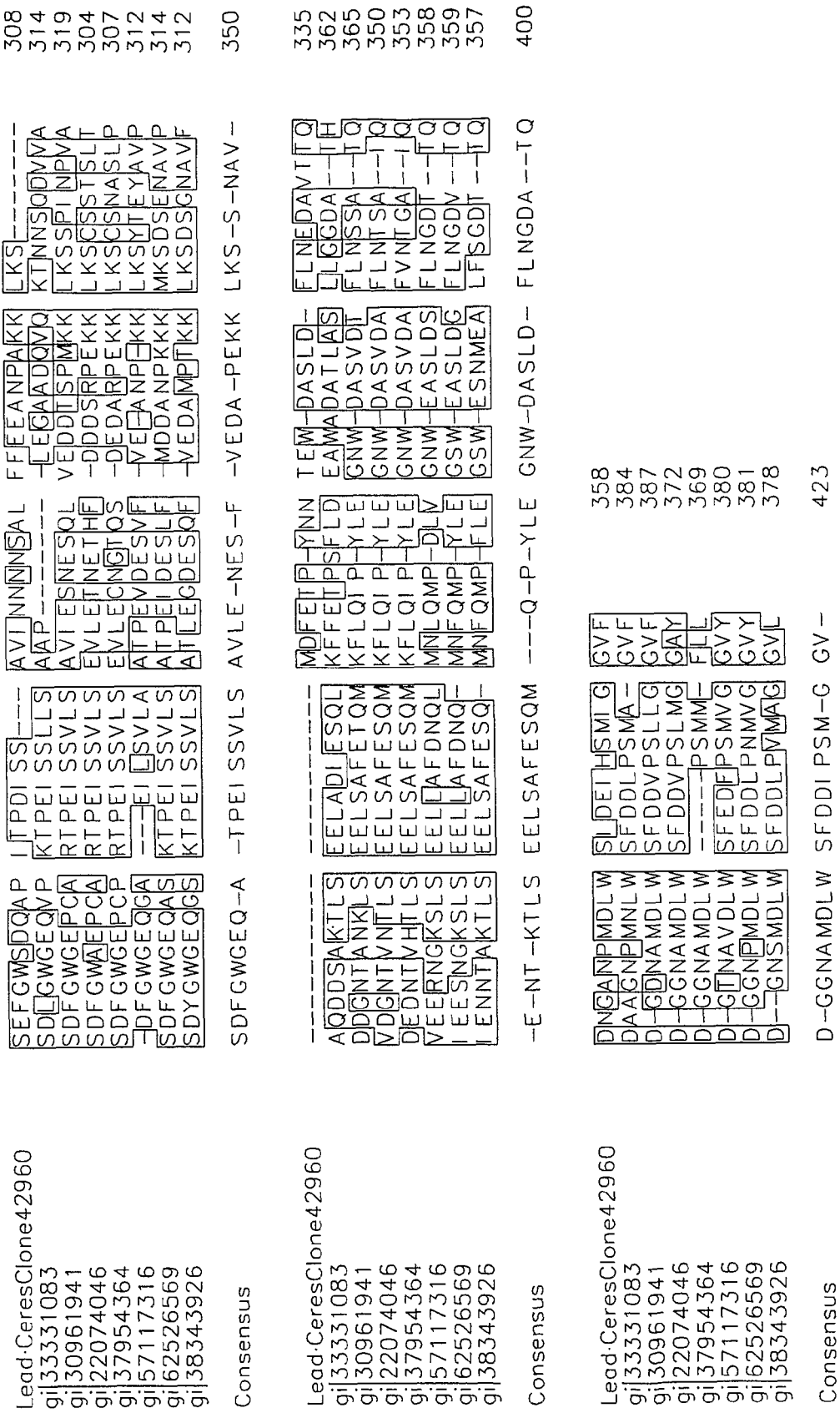

FIG. 78 is an alignment of the amino acid sequence of Lead CeresClone 42960 (SEQ ID NO:496) with homologous and/or orthologous amino acid sequences gi|33331083 (SEQ ID NO:497), gi|62526569 (SEQ ID NO:498), gi|37954364 (SEQ ID NO:499), gi|22074046 (SEQ ID NO:500), gi|30961941 (SEQ ID NO:501), gi|38343926 (SEQ ID NO:502), and gi|57117316 (SEQ ID NO:503). The consensus sequence determined by the alignment is set forth.

FIG. 79 is an alignment of the amino acid sequence of Lead CeresClone 45 (SEQ ID NO:505) with homologous and/or orthologous amino acid sequences CeresClone:962327 (SEQ ID NO:506) and CeresClone:1360570 (SEQ ID NO:507). The consensus sequence determined by the alignment is set forth.

FIG. 80 is an alignment of the amino acid sequence of Lead CeresClone 471089 (SEQ ID NO:509) with homologous and/or orthologous amino acid sequences gi|21537266 (SEQ ID NO:510) and CeresClone:246144 (SEQ ID NO:511). The consensus sequence determined by the alignment is set forth.

Figure 81:
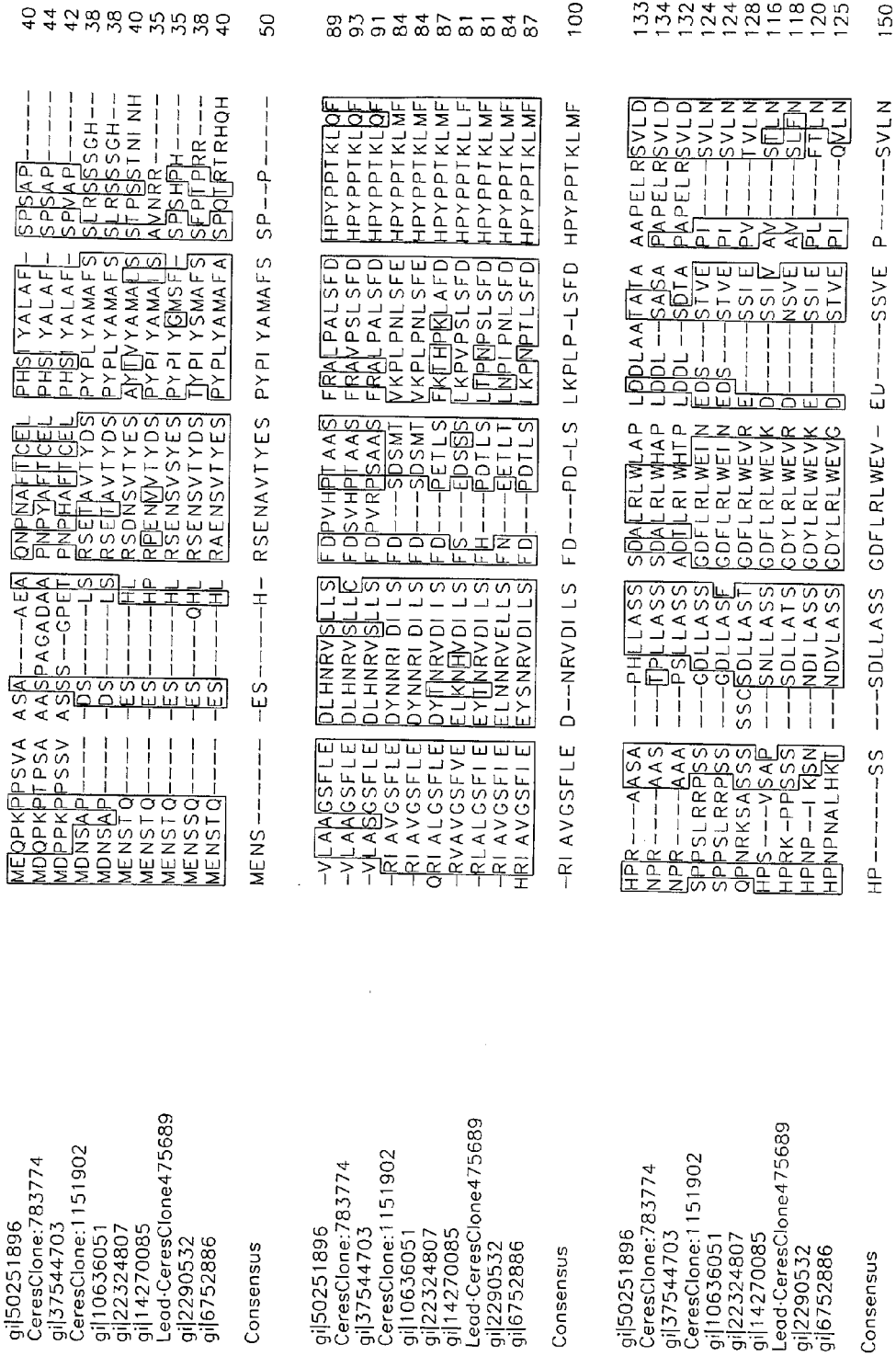
Figure 81:
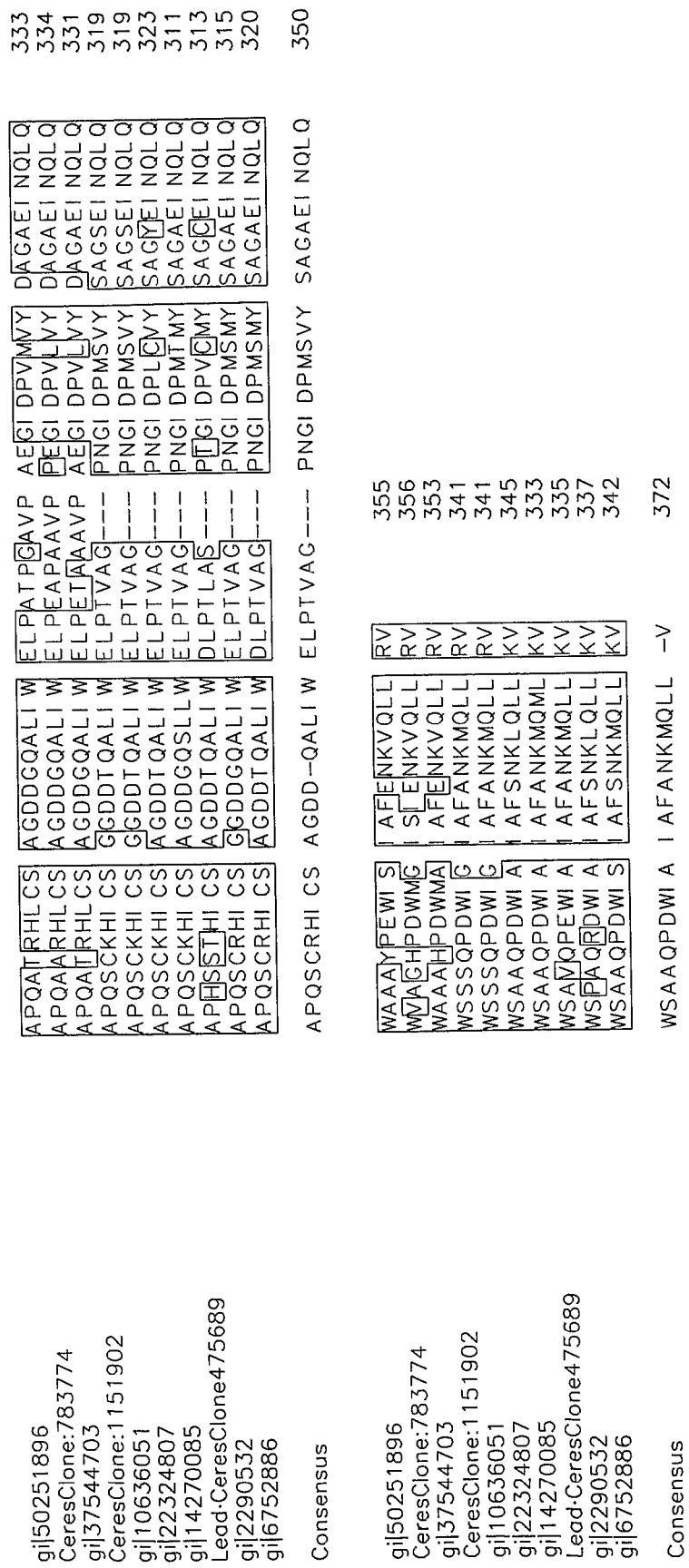

FIG. 81 is an alignment of the amino acid sequence of Lead CeresClone 475689 (SEQ ID NO:513) with homologous and/or orthologous amino acid sequences gi|22324807 (SEQ ID NO:514), CeresClone:1151902 (SEQ ID NO:515), gi|10636051 (SEQ ID NO:516), gi|6752886 (SEQ ID NO:517), gi|2290532 (SEQ ID NO:518), CeresClone:783774 (SEQ ID NO:519), gi|37544703 (SEQ ID NO:520), gi|50251896 (SEQ ID NO:521), and gi|14270085 (SEQ ID NO:522).

FIG. 82 is an alignment of the amino acid sequence of Lead CeresClone 481710 (SEQ ID NO:524) with homologous and/or orthologous amino acid sequences CeresClone:1620272 (SEQ ID NO:525), gi|37147896 (SEQ ID NO:526), gi|45826358 (SEQ ID NO:527), gi|41351817 (SEQ ID NO:528), gi|12003382 (SEQ ID NO:529), CeresClone:1052602 (SEQ ID NO:530), gi|12003384 (SEQ ID NO:531), gi|5616086 (SEQ ID NO:532), gi|38426952 (SEQ ID NO:533), gi|38426948 (SEQ ID NO:534), gi|49658405 (SEQ ID NO:535), gi|38146944 (SEQ ID NO:536), gi|10177734 (SEQ ID NO:537), and gi|38683266 (SEQ ID NO:538). The consensus sequence determined by the alignment is set forth.

Figure 83:
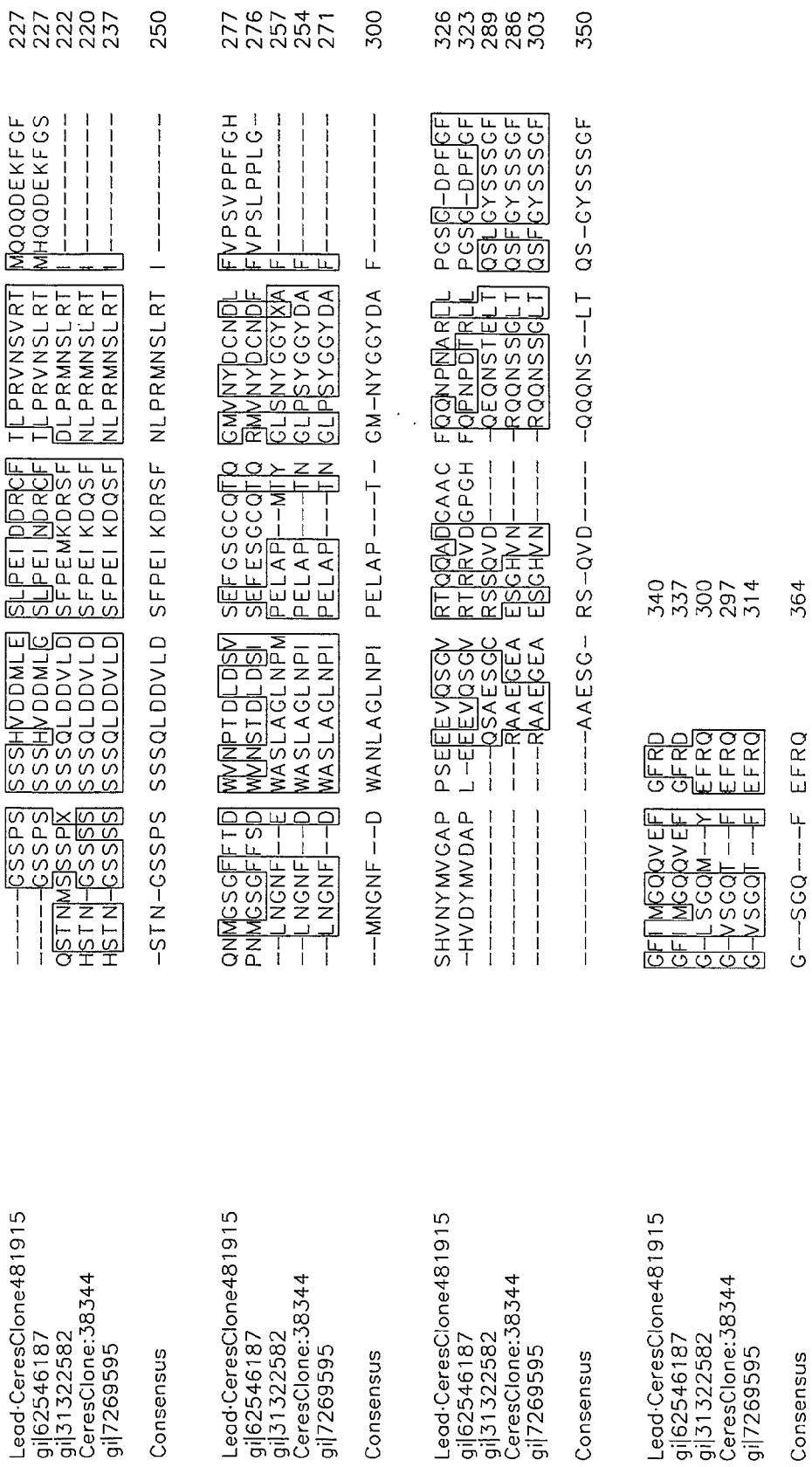

FIG. 83 is an alignment of the amino acid sequence of Lead CeresClone 481915 (SEQ ID NO:540) with homologous and/or orthologous amino acid sequences CeresClone:38344 (SEQ ID NO:541), gi|7269595 (SEQ ID NO:542), gi|31322582 (SEQ ID NO:543), and gi|62546187 (SEQ ID NO:544). The consensus sequence determined by the alignment is set forth.

FIG. 84 is an alignment of the amino acid sequence of Lead CeresClone 534311 (SEQ ID NO:548) with homologous and/or orthologous amino acid sequences gi|23197970 (SEQ ID NO:549), CeresClone:504165 (SEQ ID NO:550), gi|34909052 (SEQ ID NO:551), and gi|55296828 (SEQ ID NO:552). The consensus sequence determined by the alignment is set forth.

Figure 85:
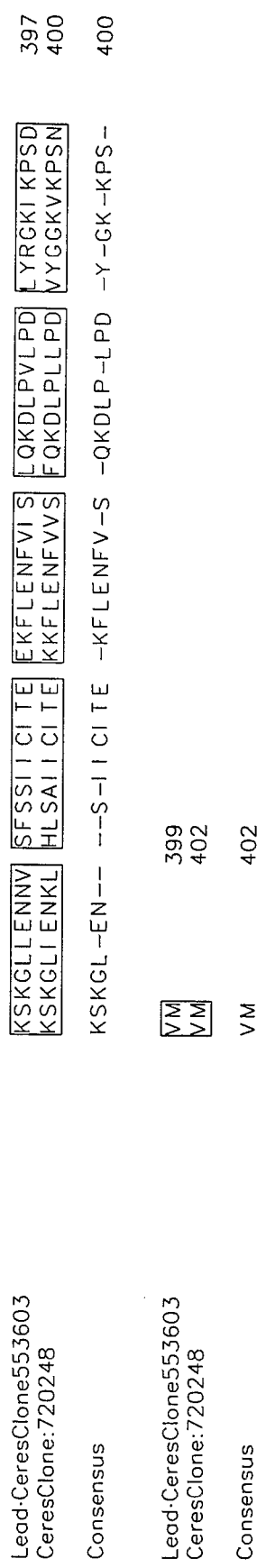

FIG. 85 is an alignment of the amino acid sequence of Lead CeresClone 553603 (SEQ ID NO:554) with homologous and/or orthologous amino acid sequence CeresClone:720248 (SEQ ID NO:555). The consensus sequence determined by the alignment is set forth.

FIG. 86 is an alignment of the amino acid sequence of Lead CeresClone 556734 (SEQ ID NO:557) with homologous and/or orthologous amino acid sequences gi|5139697 (SEQ ID NO:558), CeresClone:520455 (SEQ ID NO:559), CeresClone:574451 (SEQ ID NO:560), gi|114734 (SEQ ID NO:561), CeresClone:1113630 (SEQ ID NO:562), Ceres- Clone:1069818 (SEQ ID NO:563), and gi|50917147 (SEQ ID NO:564). The consensus sequence determined by the alignment is set forth.

FIG. 87 is an alignment of the amino acid sequence of Lead CeresClone 560681 (SEQ ID NO:566) with homologous and/or orthologous amino acid sequences gi|9294226 (SEQ ID NO:567), CeresClone:951040 (SEQ ID NO:568), CeresClone:966938 (SEQ ID NO:569), CeresClone:560948 (SEQ ID NO:570), CeresClone:653656 (SEQ ID NO:571), CeresClone:663844 (SEQ ID NO:572), CeresClone:280170 (SEQ ID NO:573), and gi|50912765 (SEQ ID NO:574). The consensus sequence determined by the alignment is set forth.

Figure 88:
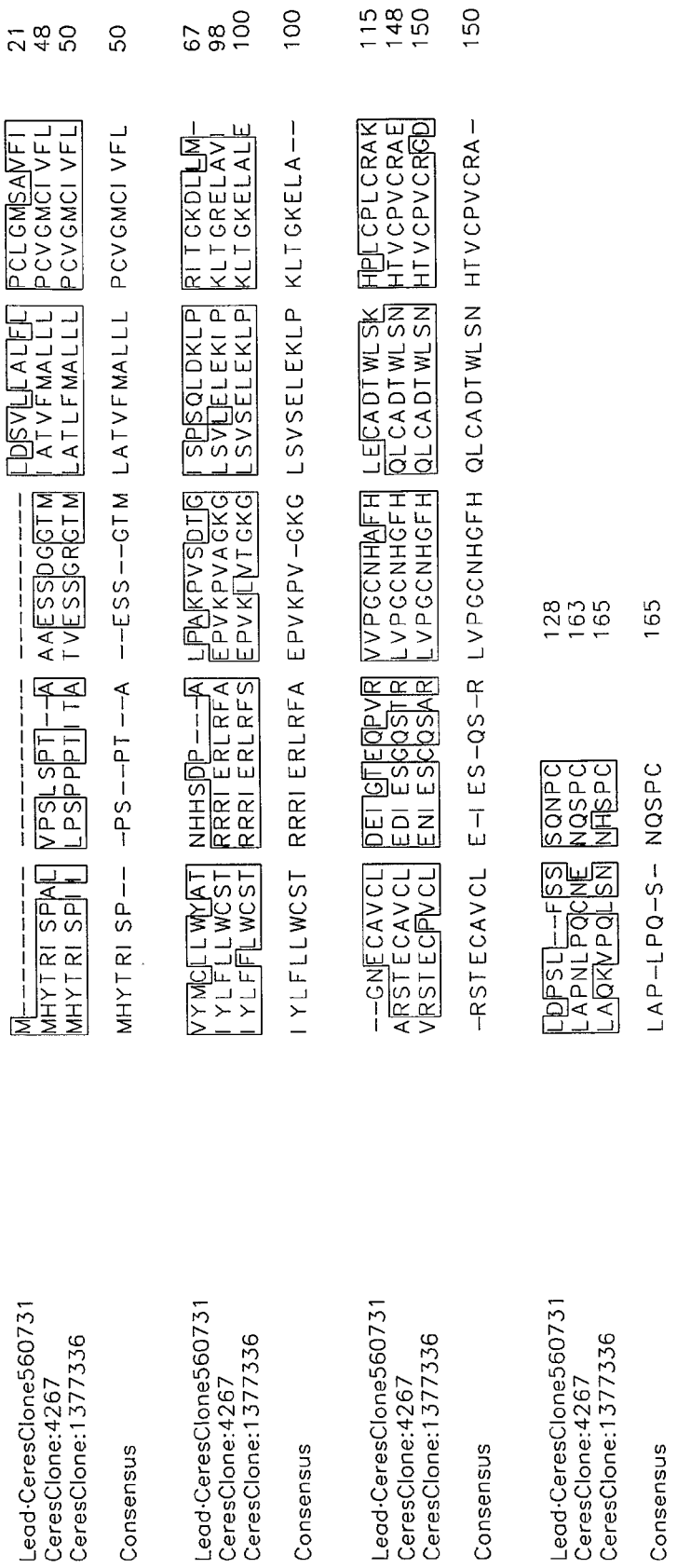

FIG. 88 is an alignment of the amino acid sequence of Lead CeresClone 560731 (SEQ ID NO:576) with homologous and/or orthologous amino acid sequences CeresClone:4267 (SEQ ID NO:577) and CeresClone:1377336 (SEQ ID NO:578). The consensus sequence determined by the alignment is set forth.

FIG. 89 is an alignment of the amino acid sequence of Lead CeresClone 6066 (SEQ ID NO:580) with homologous and/or orthologous amino acid sequences gi|4586057 (SEQ ID NO:581), CeresClone:467480 (SEQ ID NO:582), and gi|18258 (SEQ ID NO:583). The consensus sequence determined by the alignment is set forth.

FIG. 90 is an alignment of the amino acid sequence of Lead CeresClone 6568 (SEQ ID NO:589) with homologous and/or orthologous amino acid sequences gi|1869928 (SEQ ID NO:590) and gi|7489532 (SEQ ID NO:591). The consensus sequence determined by the alignment is set forth.

FIG. 91 is an alignment of the amino acid sequence of Lead CeresClone 7201 (SEQ ID NO:599) with homologous and/or orthologous amino acid sequences CeresClone:40916 (SEQ ID NO:600), CeresClone:879445 (SEQ ID NO:601), and CeresClone:294406 (SEQ ID NO:602). The consensus sequence determined by the alignment is set forth.

FIG. 92 is an alignment of the amino acid sequence of Lead CeresClone 7805 (SEQ ID NO:604) with homologous and/or orthologous amino acid sequence CeresClone:1045975 (SEQ ID NO:605). The consensus sequence determined by the alignment is set forth.

Figure 93:
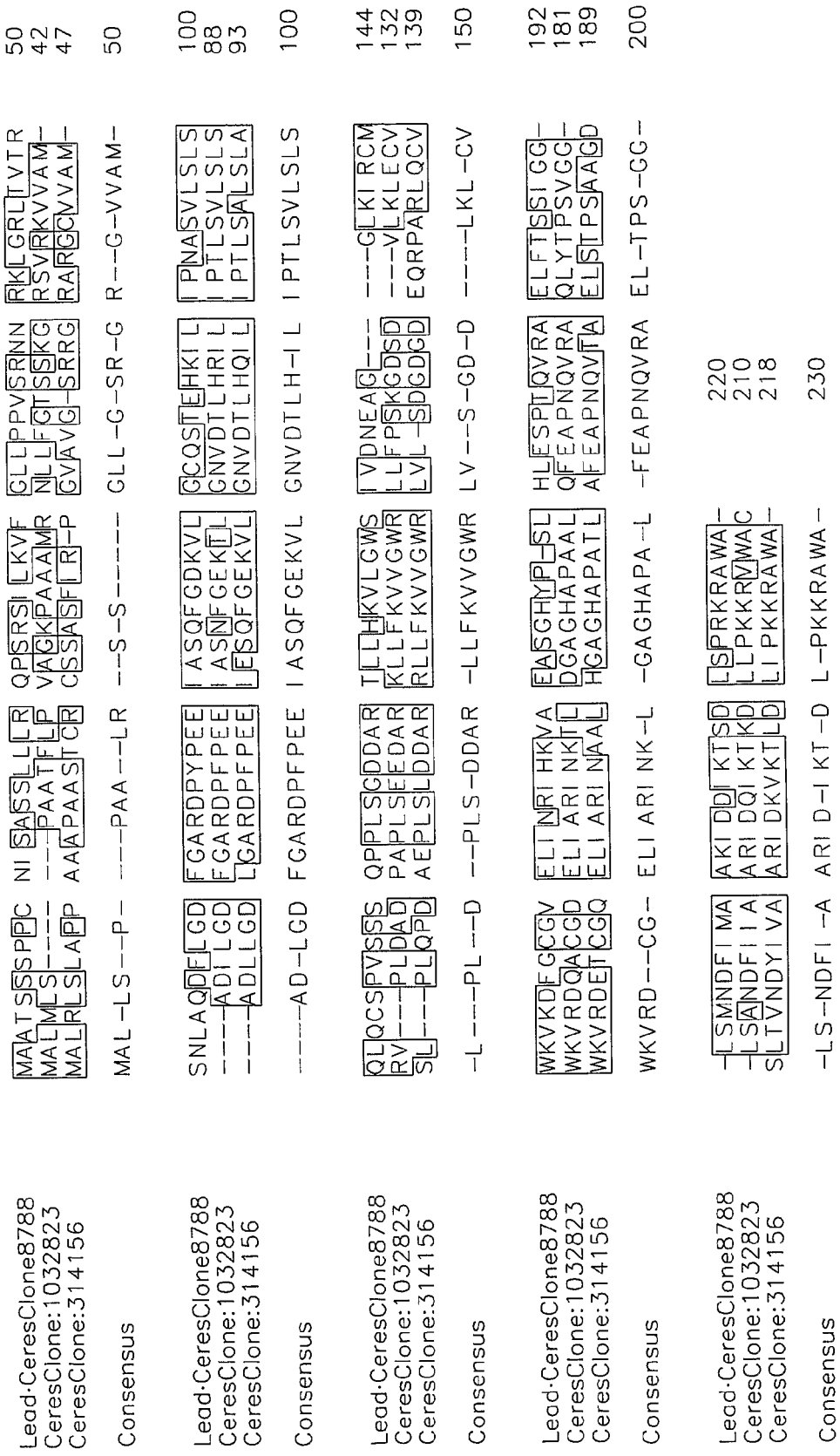

FIG. 93 is an alignment of the amino acid sequence of Lead CeresClone 8788 (SEQ ID NO:607) with homologous and/or orthologous amino acid sequences CeresClone:1032823 (SEQ ID NO:608) and CeresClone:314156 (SEQ ID NO:609). The consensus sequence determined by the alignment is set forth.

FIG. 94 is an alignment of the amino acid sequence of Lead CeresClone 955048 (SEQ ID NO:613) with homologous and/or orthologous amino acid sequence gi|3128213 (SEQ ID NO:614). The consensus sequence determined by the alignment is set forth.

FIG. 95 is an alignment of the amino acid sequence of Lead CeresClone 968026 (SEQ ID NO:618) with homologous and/or orthologous amino acid sequences gi|28466913 (SEQ ID NO:619) and gi|4678318 (SEQ ID NO:620). The consensus sequence determined by the alignment is set forth.

FIG. 96 is an alignment of the amino acid sequence of Lead CeresClone 99075 (SEQ ID NO:624) with homologous and/or orthologous amino acid sequences gi|25518040 (SEQ ID NO:625), CeresClone:971321 (SEQ ID NO:626), CeresClone:516604 (SEQ ID NO:627), and CeresClone:1403244 (SEQ ID NO:628). The consensus sequence determined by the alignment is set forth.

FIG. 97 is an alignment of the amino acid sequence of Lead CeresClone 99519 (SEQ ID NO:630) with homologous and/or orthologous amino acid sequences CeresClone:478849 (SEQ ID NO:631), CeresClone:575526 (SEQ ID NO:632), CeresClone:282105 (SEQ ID NO:633), and gi|50510178 (SEQ ID NO:634). The consensus sequence determined by the alignment is set forth.

FIG. 98 is an alignment of the amino acid sequence of Lead CeresClone 3774 (SEQ ID NO:636) with homologous and/or orthologous amino acid sequence CeresClone:1035997 (SEQ ID NO:637). The consensus sequence determined by the alignment is set forth.

Figure 99:
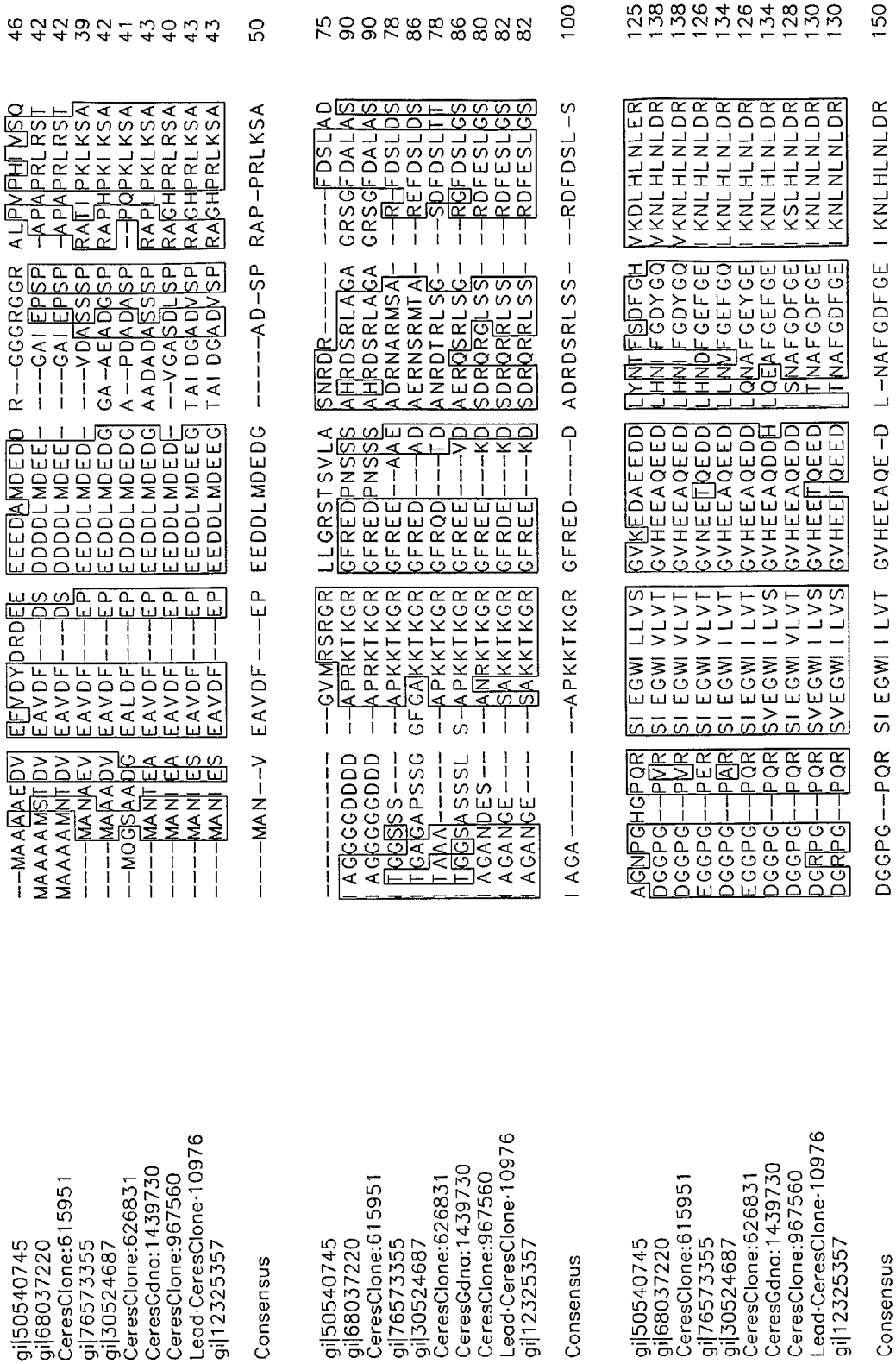
Figure 99:
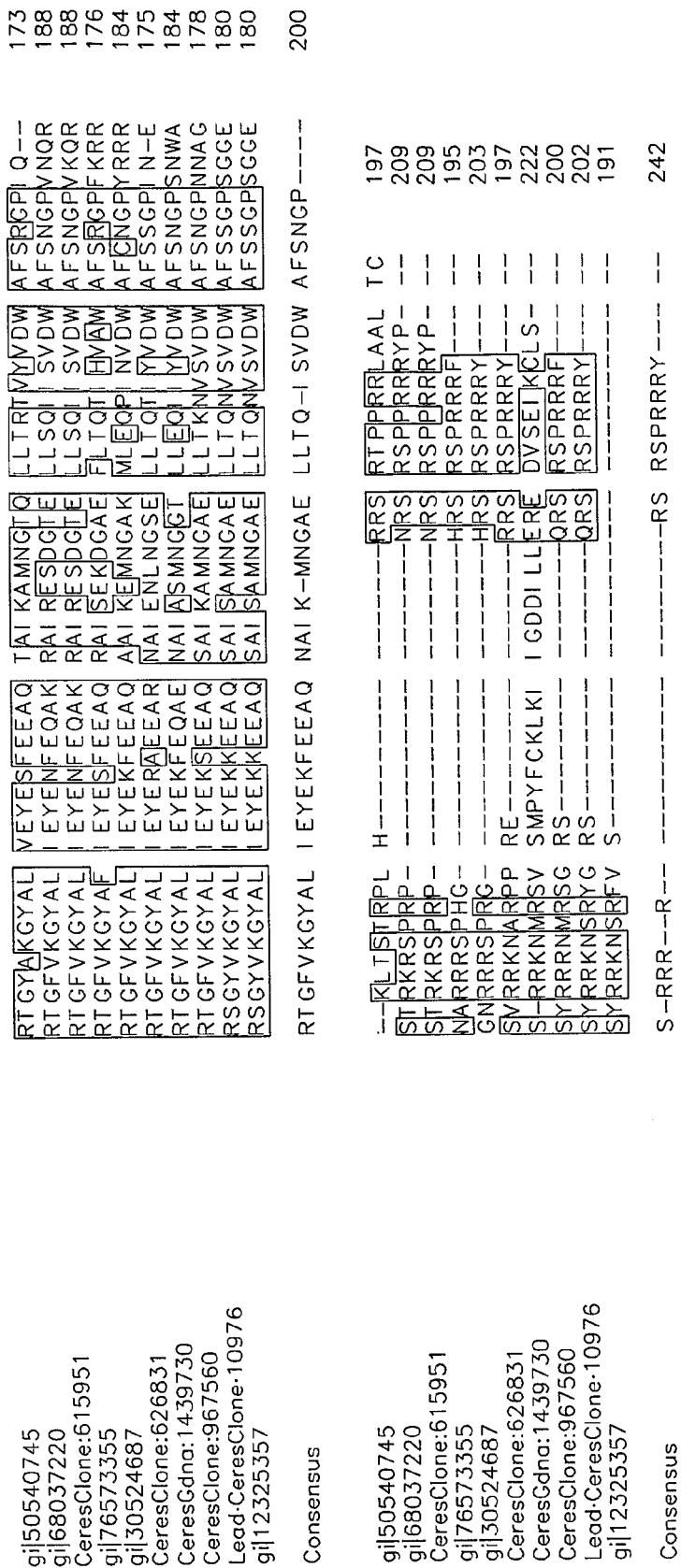

FIG. 99 is an alignment of the amino acid sequence of Lead CeresClone 10976 (SEQ ID NO:642) with homologous and/or orthologous amino acid sequences gi|12325357 (SEQ ID NO:643), CeresClone:967560 (SEQ ID NO:644), CeresGdna:1439730 (SEQ ID NO:646), CeresClone:626831 (SEQ ID NO:647), gi|30524687 (SEQ ID NO:648), gi|76573355 (SEQ ID NO:649), gi|68037220 (SEQ ID NO:650), CeresClone:615951 (SEQ ID NO:651), and gi|50540745 (SEQ ID NO:652). The consensus sequence determined by the alignment is set forth.

Figure 100:
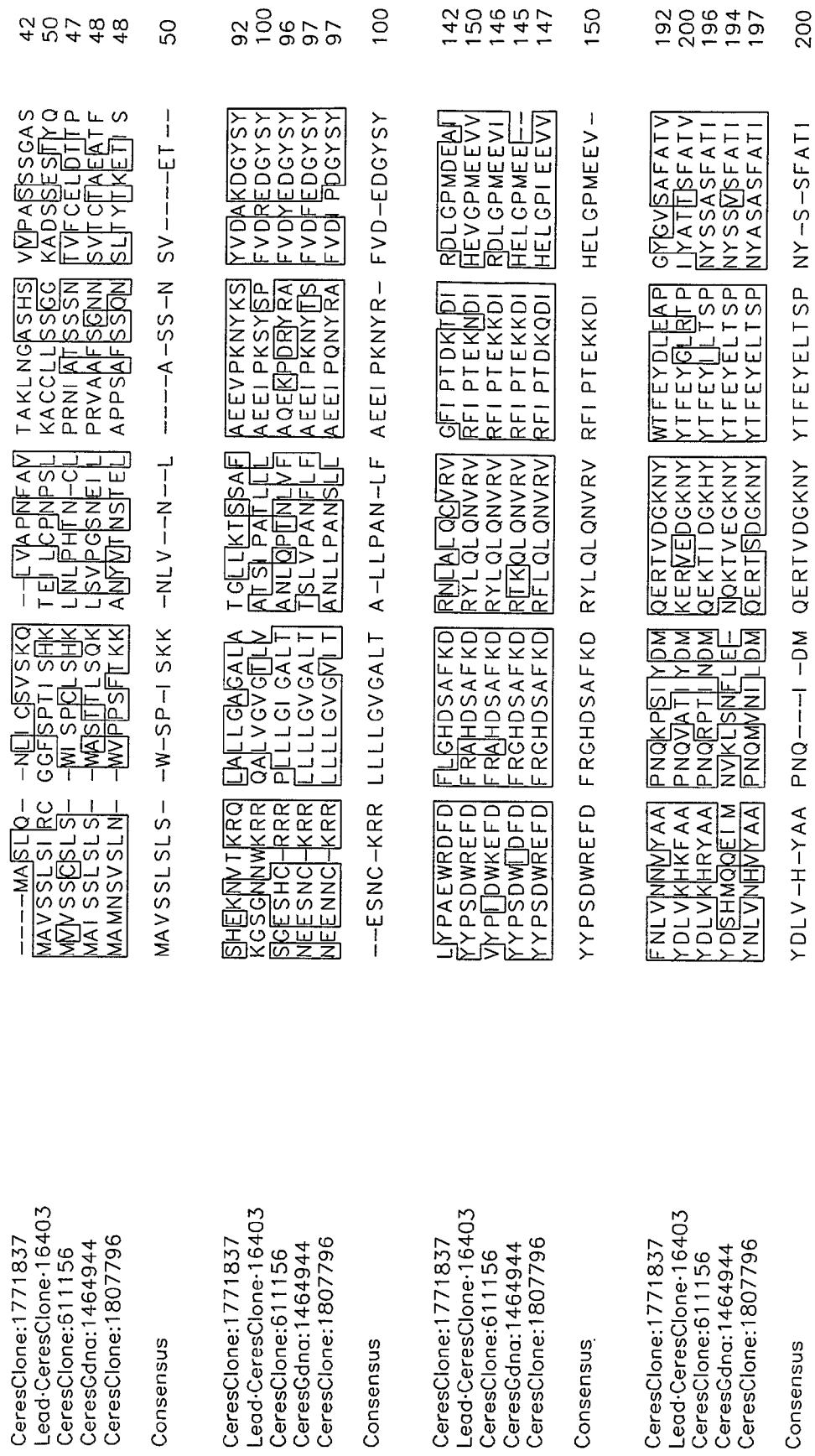

FIG. 100 is an alignment of the amino acid sequence of Lead CeresClone 16403 (SEQ ID NO:656) with homologous and/or orthologous amino acid sequences CeresClone:1807796 (SEQ ID NO:657), CeresClone:611156 (SEQ ID NO:658), CeresGdna:1464944 (SEQ ID NO:660), and CeresClone:1771837 (SEQ ID NO:661). The consensus sequence determined by the alignment is set forth.

FIG. 101 is an alignment of the amino acid sequence of Lead CeresClone 16450 (SEQ ID NO:663) with homologous and/or orthologous amino acid sequence CeresClone:974460 (SEQ ID NO:664). The consensus sequence determined by the alignment is set forth.

Figure 102:
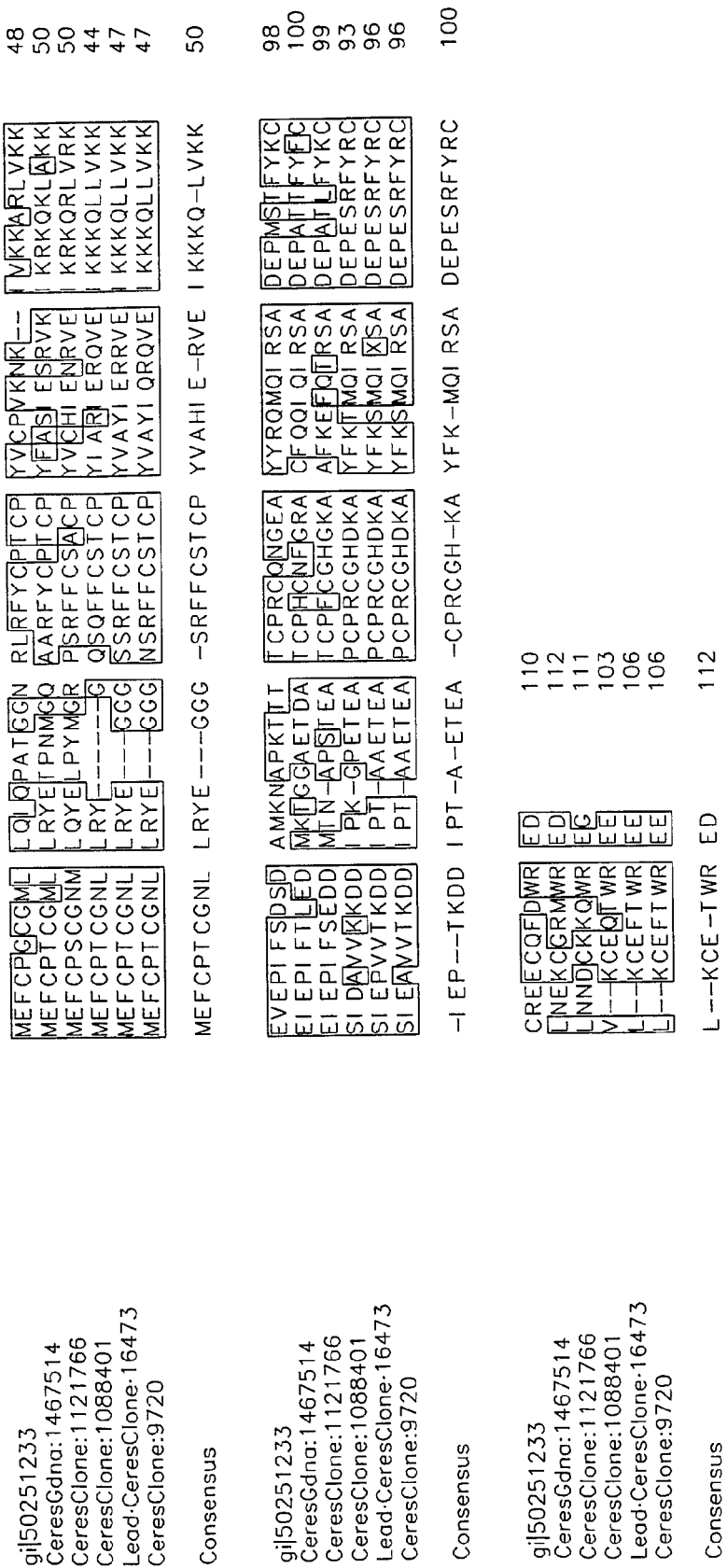

FIG. 102 is an alignment of the amino acid sequence of Lead CeresClone 16473 (SEQ ID NO:666) with homologous and/or orthologous amino acid sequences CeresClone:9720 (SEQ ID NO:667), CeresClone:1088401 (SEQ ID NO:668), CeresClone:1121766 (SEQ ID NO:669), CeresGdna:1467514 (SEQ ID NO:671), and gi|50251233 (SEQ ID NO:672). The consensus sequence determined by the alignment is set forth.

FIG. 103 is an alignment of the amino acid sequence of Lead CeresClone 21863 (SEQ ID NO:676) with homologous and/or orthologous amino acid sequence gi|34902106 (SEQ ID NO:677). The consensus sequence determined by the alignment is set forth.

FIG. 104 is an alignment of the amino acid sequence of Lead CeresClone 34553 (SEQ ID NO:690) with homologous and/or orthologous amino acid sequences CeresClone:463380 (SEQ ID NO:691), CeresGdna:1534144 (SEQ ID NO:693), gi|34903896 (SEQ ID NO:694), CeresGdna:1479838 (SEQ ID NO:696), and gi|92871553 (SEQ ID NO:697). The consensus sequence determined by the alignment is set forth.

FIG. 105 is an alignment of the amino acid sequence of Lead CeresClone 40196 (SEQ ID NO:707) with homologous and/or orthologous amino acid sequence CeresClone:467905 (SEQ ID NO:708). The consensus sequence determined by the alignment is set forth.

Figure 106:
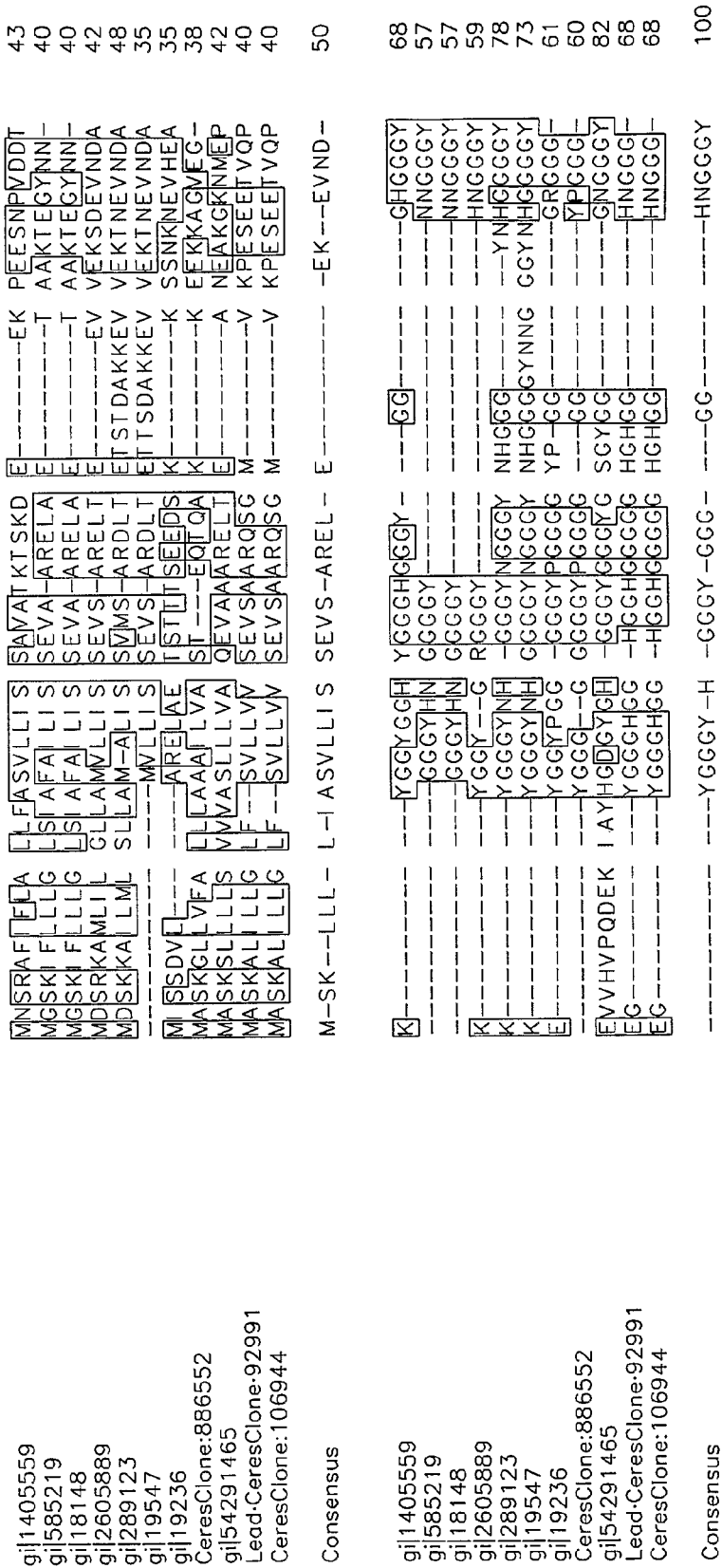
Figure 106:
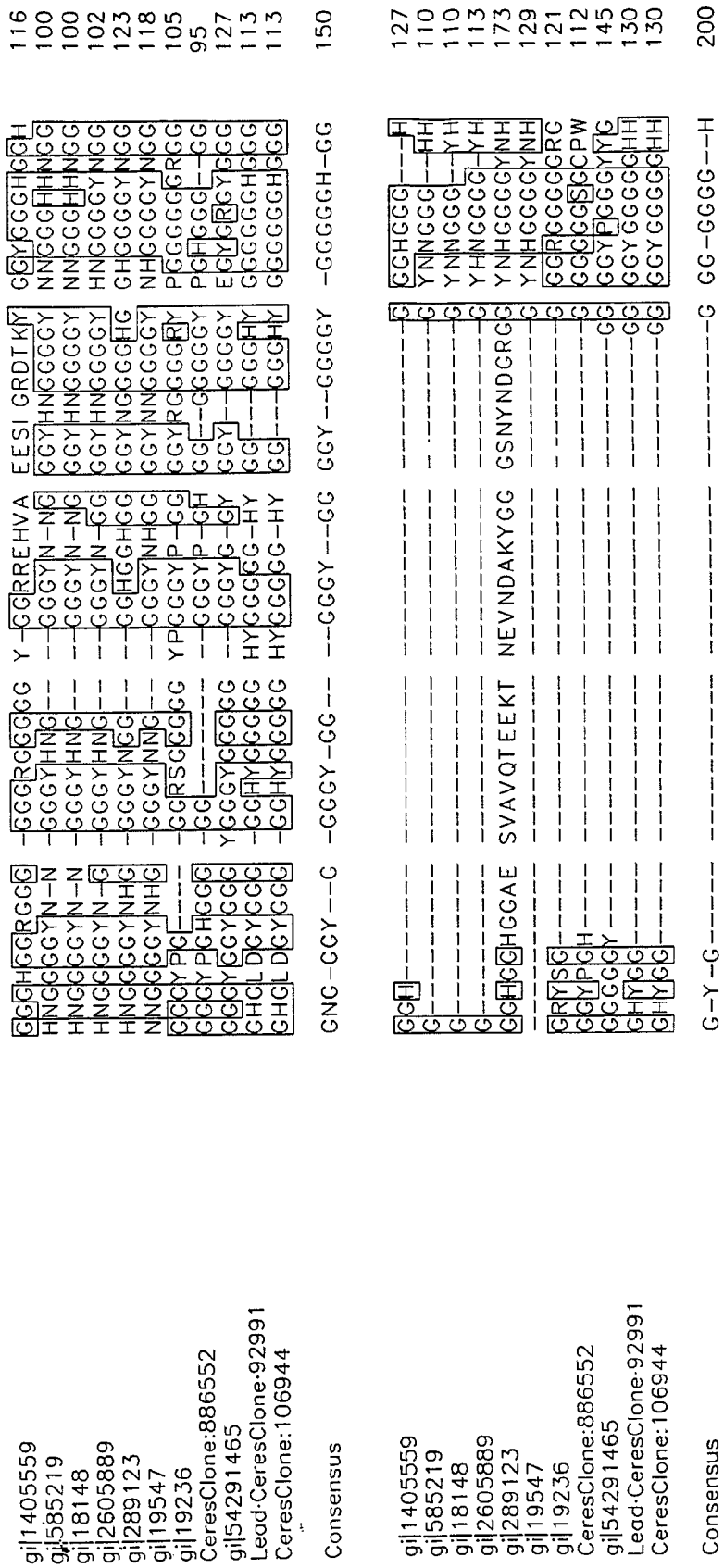
Figure 106:
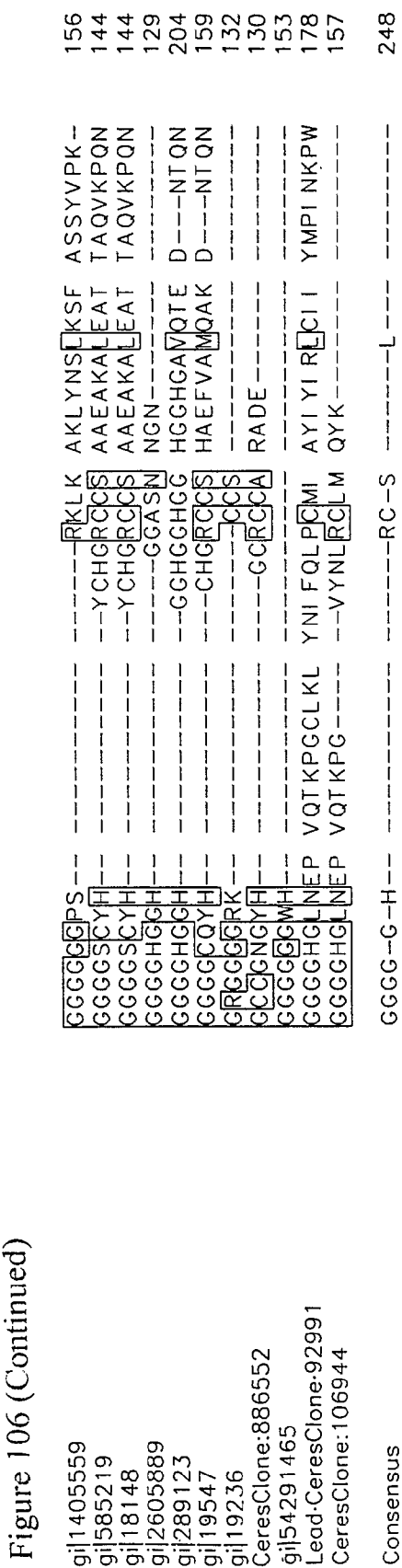

FIG. 106 is an alignment of the amino acid sequence of Lead CeresClone 92991 (SEQ ID NO:712) with homologous and/or orthologous amino acid sequences CeresClone:106944 (SEQ ID NO:713), gi|289123 (SEQ ID NO:714), gi|54291465 (SEQ ID NO:715), gi|1405559 (SEQ ID NO:716), gi|585219 (SEQ ID NO:717), gi|19236 (SEQ ID NO:718), gi|18148 (SEQ ID NO:719), gi|2605889 (SEQ ID NO:720), gi|19547 (SEQ ID NO:721), and CeresClone:886552 (SEQ ID NO:722). The consensus sequence determined by the alignment is set forth.

Figure 107:
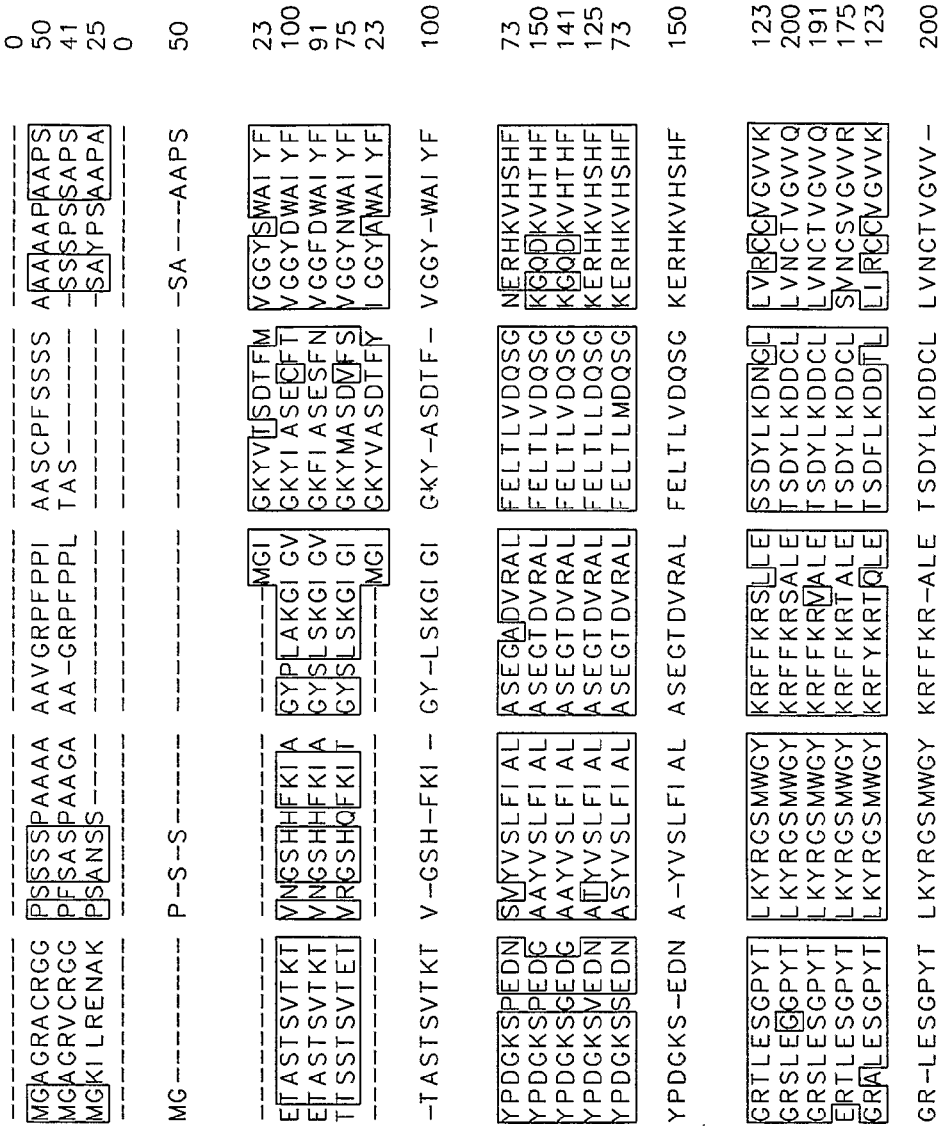

FIG. 107 is an alignment of the amino acid sequence of Lead CeresClone 113719 (SEQ ID NO:730) with homologous and/or orthologous amino acid sequences CeresClone: 713993 (SEQ ID NO:732), CeresGdna:1513206 (SEQ ID NO:734), gi|50939715 (SEQ ID NO:735), and CeresClone: 288779 (SEQ ID NO:736). The consensus sequence determined by the alignment is set forth.

FIG. 108 is an alignment of the amino acid sequence of Lead CeresClone 150246 (SEQ ID NO:742) with homologous and/or orthologous amino acid sequences CeresGdna: 1486526 (SEQ ID NO:744), gi|92881423 (SEQ ID NO:745), and gi|55741380 (SEQ ID NO:746). The consensus sequence determined by the alignment is set forth.

FIG. 109 is an alignment of the amino acid sequence of Lead CeresClone 206045 (SEQ ID NO:752) with homologous and/or orthologous amino acid sequences gi|16323412 (SEQ ID NO:753), CeresClone:1370494 (SEQ ID NO:754), CeresGdna:1464350 (SEQ ID NO:756), and CeresClone: 584351 (SEQ ID NO:757). The consensus sequence determined by the alignment is set forth.

FIG. 110 is an alignment of the amino acid sequence of Lead CeresClone 207834 (SEQ ID NO:761) with homologous and/or orthologous amino acid sequences CeresClone: 384289 (SEQ ID NO:762), gi|50923969 (SEQ ID NO:763), gi|25990491 (SEQ ID NO:765), and CeresClone:710471 (SEQ ID NO:766). The consensus sequence determined by the alignment is set forth.

Figure 111:
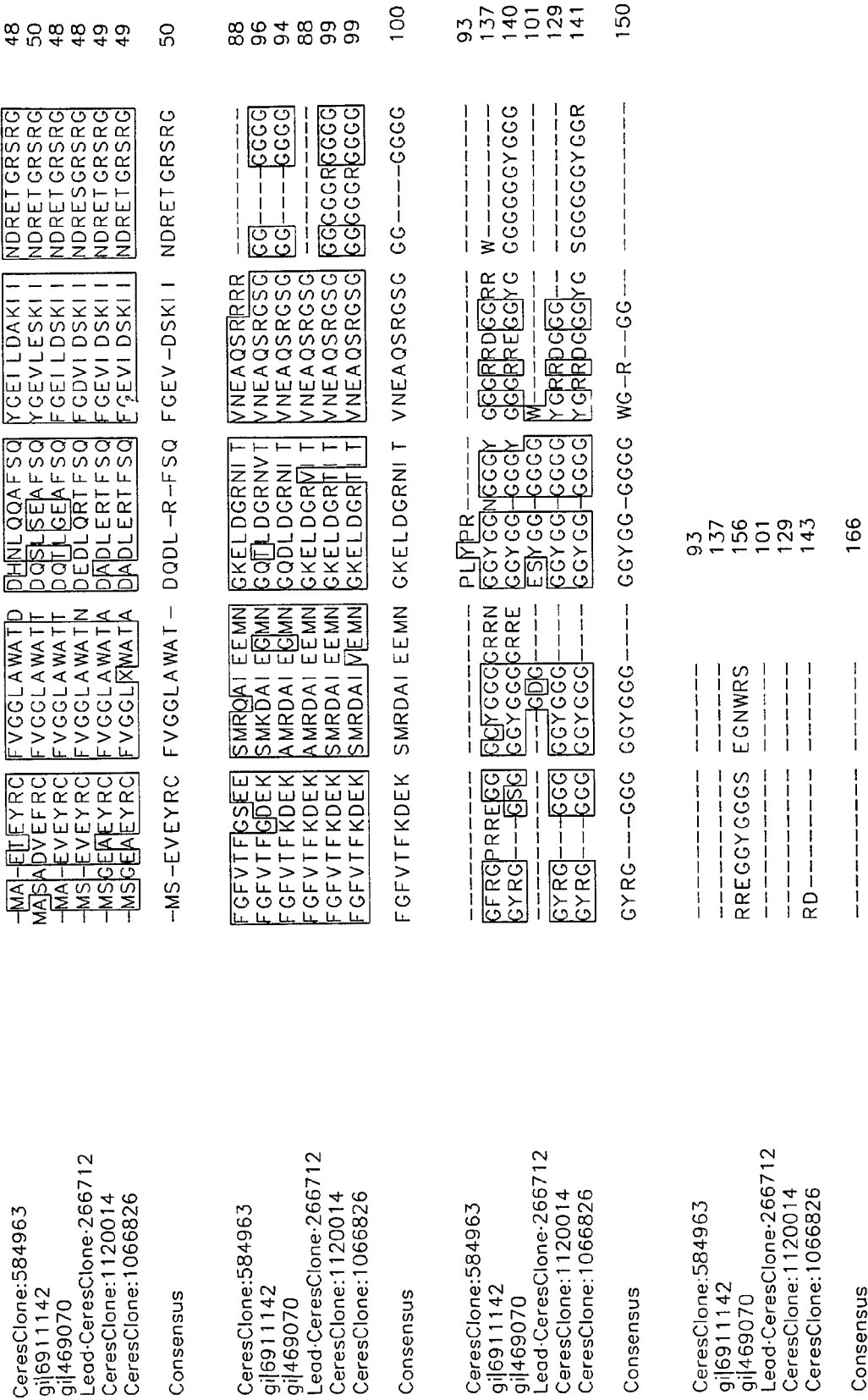

FIG. 111 is an alignment of the amino acid sequence of Lead CeresClone 266712 (SEQ ID NO:772) with homologous and/or orthologous amino acid sequences CeresClone: 1120014 (SEQ ID NO:783), CeresClone:1066826 (SEQ ID NO:784), gi|469070 (SEQ ID NO:786), CeresClone:584963 (SEQ ID NO:787), and gi|6911142 (SEQ ID NO:793). The consensus sequence determined by the alignment is set forth.

Figure 112:
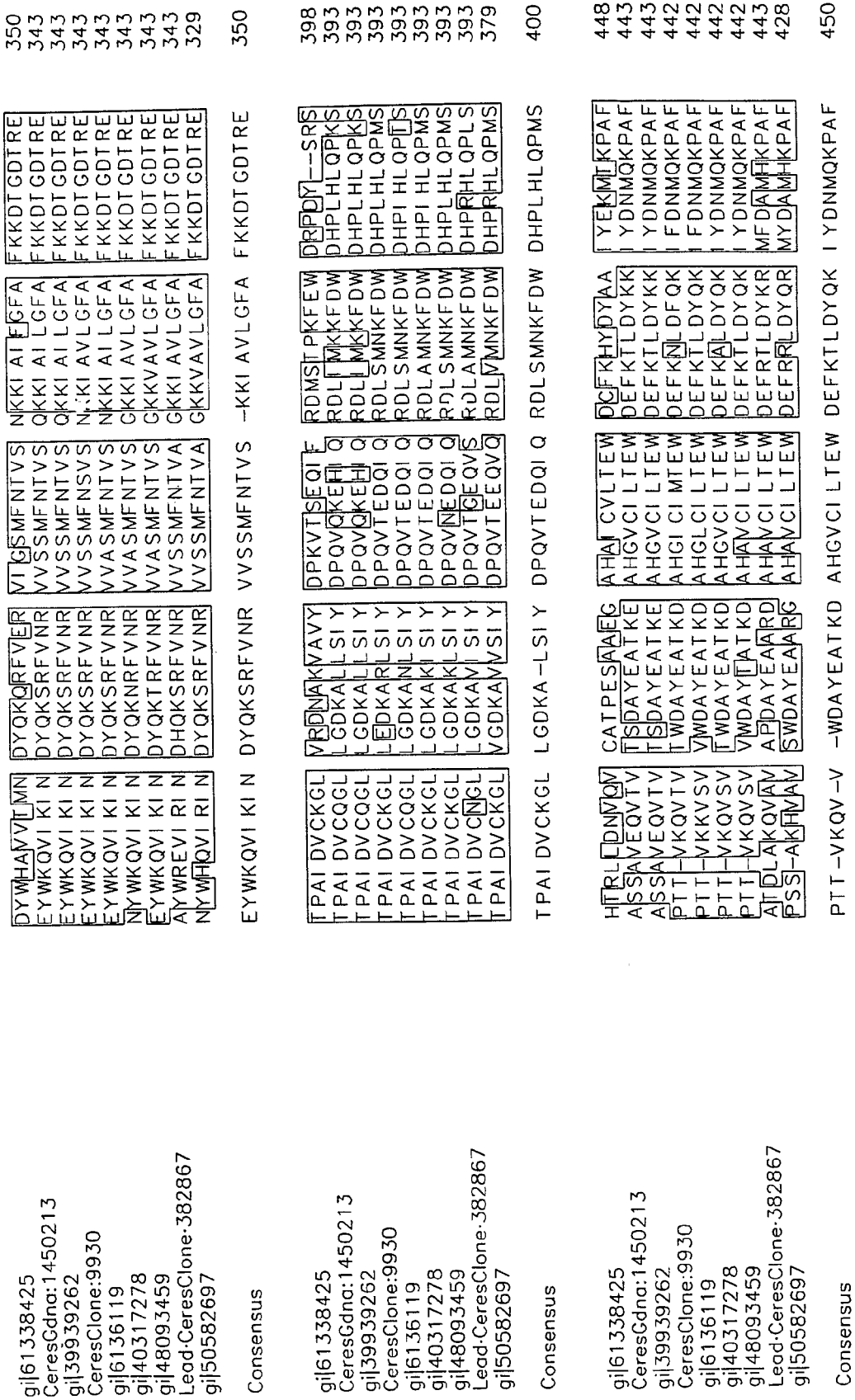

FIG. 112 is an alignment of the amino acid sequence of Lead CeresClone 382867 (SEQ ID NO:809) with homologous and/or orthologous amino acid sequences gi|50582697 (SEQ ID NO:810), gi|40317278 (SEQ ID NO:811), gi|48093459 (SEQ ID NO:812), gi|6136119 (SEQ ID NO:813), CeresGdna:1450213 (SEQ ID NO:815), gi|39939262 (SEQ ID NO:816), CeresClone:9930 (SEQ ID NO:817), and gi|61338425 (SEQ ID NO:818). The consensus sequence determined by the alignment is set forth.

FIG. 113 is an alignment of the amino acid sequence of Lead cDNA ID 12575172 (SEQ ID NO:836) with homologous and/or orthologous amino acid sequence CeresGdna: 1519981 (SEQ ID NO:838). The consensus sequence determined by the alignment is set forth.

FIG. 114 is an alignment of the amino acid sequence of Lead cDNA ID 12605556 (SEQ ID NO:840) with homologous and/or orthologous amino acid sequences CeresGdna: 1455463 (SEQ ID NO:842), gi|54290426 (SEQ ID NO:843), CeresClone:372747 (SEQ ID NO:844), CeresClone:553394 (SEQ ID NO:845), gi|34912704 (SEQ ID NO:846), and CeresClone:678505 (SEQ ID NO:847). The consensus sequence determined by the alignment is set forth.

Figure 115:
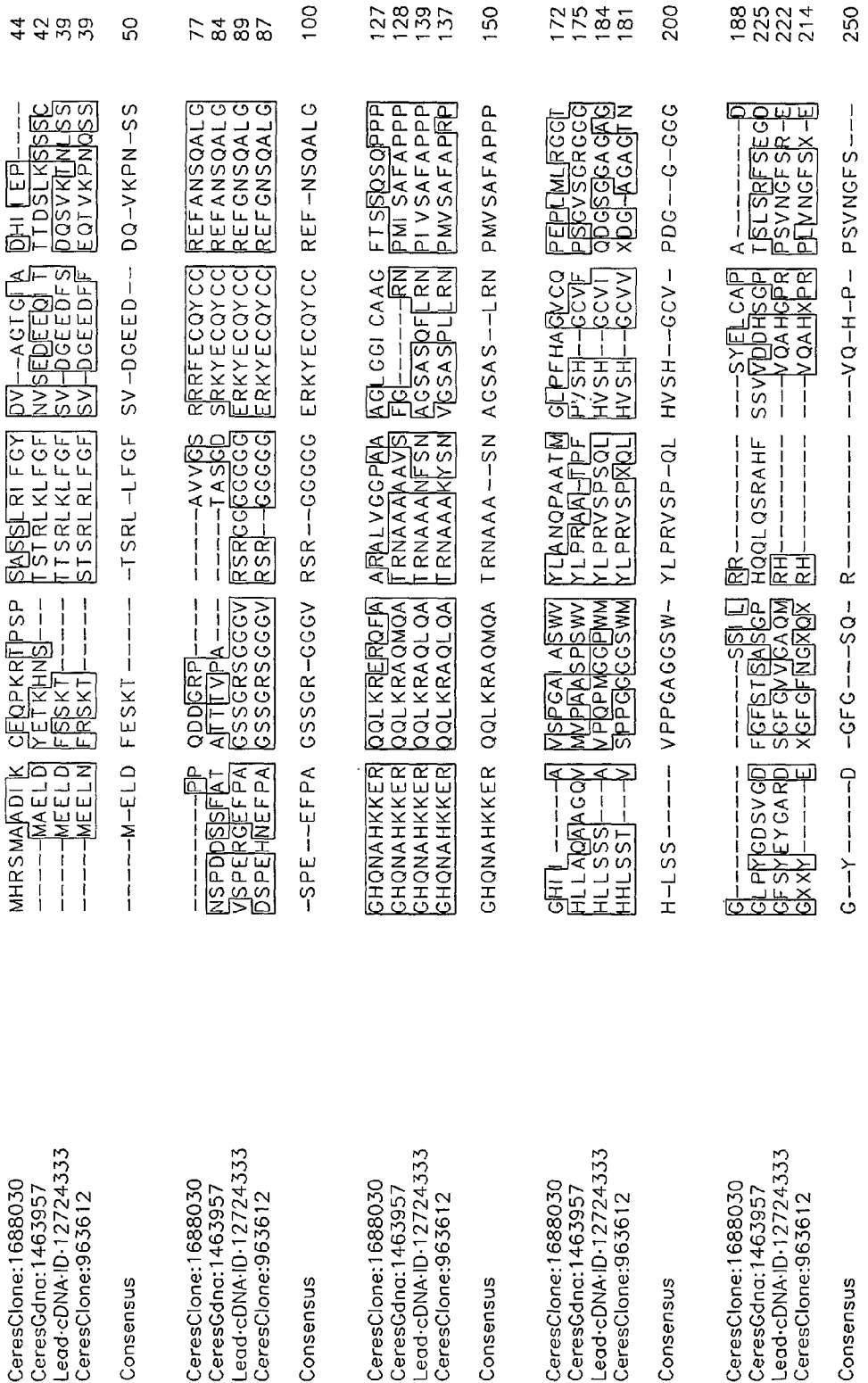

FIG. 115 is an alignment of the amino acid sequence of Lead cDNA ID 12724333 (SEQ ID NO:849) with homologous and/or orthologous amino acid sequences CeresClone: 963612 (SEQ ID NO:850), CeresGdna:1463957 (SEQ ID NO:852), and CeresClone:1688030 (SEQ ID NO:853). The consensus sequence determined by the alignment is set forth.

DETAILED DESCRIPTION

Applicants have discovered novel methods of screening for regulatory proteins that can modulate expression of a gene, e.g., a reporter gene, operably linked to a regulatory region, such as a regulatory region involved in terpenoid biosynthesis. These discoveries can be used to create plant cells and plants containing (1) a nucleic acid encoding a regulatory protein, and/or (2) a nucleic acid including a regulatory region associated with a given regulatory protein, e.g., to modulate expression of a sequence of interest operably linked to the regulatory region.

Thus, in one aspect, the invention features a method for identifying a regulatory protein capable of activating a regulatory region. The method involves screening for the ability of the regulatory protein to modulate expression of a reporter that is operably linked to the regulatory region. The ability of the regulatory protein to modulate expression of the reporter is determined by monitoring reporter activity.

A regulatory protein and a regulatory region are considered to be "associated" when the regulatory protein is capable of modulating expression, either directly or indirectly, of a nucleic acid operably linked to the regulatory region. For example, a regulatory protein and a regulatory region can be said to be associated when the regulatory protein directly binds to the regulatory region, as in a transcription factor-promoter complex. In other cases, a regulatory protein and regulatory region can be said to be associated when the regulatory protein does not directly bind to the regulatory region. A regulatory protein and a regulatory region can also be said to be associated when the regulatory protein indirectly affects transcription by being a component of a protein complex involved in transcriptional regulation or by noncovalently binding to a protein complex involved in transcriptional regulation. In some cases, a regulatory protein and regulatory region can be said to be associated and indirectly affect transcription when the regulatory protein participates in or is a component of a signal transduction cascade or a proteasome degradation pathway (e.g., of repressors) that results in transcriptional amplification or repression. In some cases, regulatory proteins associate with regulatory regions and indirectly affect transcription by, e.g., binding to methylated DNA, unwinding chromatin, or binding to RNA.

A regulatory protein and its associated regulatory region can be used to selectively modulate expression of a sequence of interest, when such a sequence is operably linked to the regulatory region. In addition, the use of such regulatory protein-regulatory region associations in plants can permit selective modulation of the amount or rate of biosynthesis of plant polypeptides and plant compound(s), such as terpenoid compounds, under a desired environmental condition or in a desired plant developmental pathway.

Polypeptides

The term "polypeptide" as used herein refers to a compound of two or more subunit amino acids, amino acid analogs, or other peptidomimetics, regardless of post-translational modification, e.g., phosphorylation or glycosylation. The subunits may be linked by peptide bonds or other bonds such as, for example, ester or ether bonds. The term "amino acid" refers to natural and/or unnatural or synthetic amino acids, including D/L optical isomers. Full-length proteins, analogs, mutants, and fragments thereof are encompassed by this definition.

The term "isolated" with respect to a polypeptide refers to a polypeptide that has been separated from cellular components that naturally accompany it. Typically, the polypeptide is isolated when it is at least 60%, e.g., 70%, 80%, 90%, 95%, or 99%, by weight, free from polypeptides and naturally occurring organic molecules that are naturally associated with it. In general, an isolated polypeptide will yield a single major band on a reducing and/or non-reducing polyacrylamide gel. Isolated polypeptides can be obtained, for example, by extraction from a natural source (e.g., plant tissue), chemical synthesis, or by recombinant production in a host plant cell. To recombinantly produce a polypeptide, a nucleic acid sequence containing a nucleotide sequence encoding a polypeptide of interest can be ligated into an expression vector and used to transform a bacterial, eukaryotic, or plant host cell, e.g., insect, yeast, mammalian, or plant cells. The expressed polypeptide can be extracted from the host cells and purified using techniques known to those of skill in the art.

Polypeptides described herein include regulatory proteins. Such a regulatory protein typically is effective for modulating expression of a nucleic acid sequence operably linked to a regulatory region involved in a terpenoid biosynthesis pathway, such as a nucleic acid sequence encoding a polypeptide involved in terpenoid biosynthesis. Modulation of expression of a nucleic acid sequence can be either an increase or a decrease in expression of the nucleic acid sequence relative to the average rate or level of expression of the nucleic acid sequence in a control plant.

A regulatory protein can have one or more domains characteristic of a zinc finger transcription factor polypeptide. For example, a regulatory protein can contain a zf-C3HC4 domain characteristic of a C3HC4 type (RING finger) zinc-finger polypeptide. The RING finger is a specialized type of zinc-finger of 40 to 60 residues that binds two atoms of zinc and is reported to be involved in mediating polypeptide-polypeptide interactions. There are two different variants, the C3HC4-type and a C3H2C3-type, which are related despite the different cysteine/histidine pattern. The RING domain has been implicated in diverse biological processes. Ubiquitin-protein ligases (E3s), which determine the substrate specificity for ubiquitylation, have been classified into HECT and RING-finger families. Various RING fingers exhibit binding to E2 ubiquitin-conjugating enzymes. SEQ ID NO:29, SEQ ID NO:51, SEQ ID NO:113, SEQ ID NO:129, SEQ ID NO:141, SEQ ID NO:149, SEQ ID NO:277, SEQ ID NO:368, SEQ ID NO:391, SEQ ID NO:576, SEQ ID NO:585, SEQ ID NO:599, SEQ ID NO:676, SEQ ID NO:770, SEQ ID NO:688, and SEQ ID NO:701 set forth the amino acid sequences of DNA clones, identified herein as Ceres CDNA ID no. 23500965 (SEQ ID NO:28), Ceres CDNA ID no. 23521525 (SEQ ID NO:50), Ceres CLONE ID no. 106078 (SEQ ID NO:112), Ceres CLONE ID no. 116843 (SEQ ID NO:128), Ceres CLONE ID no. 120947 (SEQ ID NO:140), Ceres CLONE ID no. 125922 (SEQ ID NO:148), Ceres CLONE ID no. 232985 (SEQ ID NO:276), Ceres CLONE ID no. 335471 (SEQ ID NO:367), Ceres CLONE ID no. 336888 (SEQ ID NO:390), Ceres CLONE ID no. 560731 (SEQ ID NO:575), Ceres CLONE ID no. 6163 (SEQ ID NO:584), Ceres CLONE ID no. 7201 (SEQ ID NO:598), Ceres CLONE ID no. 21863 (SEQ ID NO:675), Ceres CLONE ID no. 261272 (SEQ ID NO:769), Ceres CLONE ID no. 34363 (SEQ ID NO:687), and Ceres CLONE ID no. 36399 (SEQ ID NO:700), respectively, each of which is predicted to encode a C3HC4 type (RING finger) zinc-finger polypeptide.

In some cases, a regulatory protein can contain a zf-CCCH domain characteristic of C-x8-C-x5-C-x3-H type (and similar) zinc finger transcription factor polypeptides. Polypeptides containing zinc finger domains of the C-x8-C-x5-C-x3-H type include zinc finger polypeptides from eukaryotes involved in cell cycle or growth phase-related regulation, e.g. human TIS11B (butyrate response factor 1), a predicted regulatory protein involved in regulating the response to growth factors. Another polypeptide containing this domain is the human splicing factor U2AF 35 kD subunit, which plays a critical role in both constitutive and enhancer-dependent splicing by mediating essential polypeptide-polypeptide interactions and polypeptide-RNA interactions required for 3' splice site selection. It has been shown that different CCCH zinc finger polypeptides interact with the 3' untranslated regions of various mRNAs. SEQ ID NO:171 and SEQ ID NO:206 set forth the amino acid sequences of DNA clones, identified herein as Ceres CLONE ID no. 149496 (SEQ ID NO:170) and Ceres CLONE ID no. 207419 (SEQ ID NO:205), respectively, each of which is predicted to encode a C-x8-C-x5-C-x3-H type zinc finger polypeptide.

In some cases, a regulatory protein having a zf-CCCH domain can also have a zf-C3HC4 domain described above. SEQ ID NO:131 sets forth the amino acid sequence of a DNA clone, identified herein as Ceres CLONE ID no. 117089 (SEQ ID NO:130), that is predicted to encode a polypeptide containing a zf-CCCH domain and a zf-C3HC4 domain.

In some cases, a regulatory protein having a zf-CCCH domain can also have a KH domain. The K homology (KH) domain is a widespread RNA-binding motif that has been detected by sequence similarity searches in such polypeptides as heterogeneous nuclear ribonucleoprotein K (hnRNP K) and ribosomal protein S3. Analysis of spatial structures of KH domains in hnRNP K and S3 has revealed that they are topologically dissimilar. The KH domain with a C-terminal βα extension has been named KH type I, and the KH domain with an N-terminal αβ extension has been named KH type II. SEQ ID NO:192 sets forth the amino acid sequence of a DNA clone, identified herein as Ceres CLONE ID no. 17632 (SEQ ID NO:191), that is predicted to encode a polypeptide containing a zf-CCCH domain and a KH domain.

In some cases, a regulatory protein can contain a zf-CCHC domain characteristic of a zinc knuckle polypeptide. The zinc knuckle is a zinc binding motif with the sequence CX2CX4HX4C, where X can be any amino acid. The motifs are common to the nucleocapsid proteins of retroviruses, and the prototype structure is from HIV. The zinc knuckle family also contains members involved in eukaryotic gene regulation. A zinc knuckle is found in eukaryotic proteins involved in RNA binding or single strand DNA binding. SEQ ID NO:832 sets forth the amino acid sequence of a DNA clone, identified herein as Ceres ANNOT no. 841947 (SEQ ID NO:831), that is predicted to encode a polypeptide having a zf-CCHC domain.

In some cases, a regulatory protein can contain a GATA domain characteristic of a GATA zinc finger transcription factor polypeptide. A number of transcription factor polypeptides, including erythroid-specific transcription factor polypeptides and nitrogen regulatory polypeptides, specifically bind the DNA sequence (A/T)GATA(A/G) in the regulatory regions of genes. They are consequently termed GATA-binding transcription factors. The interactions occur via highly-conserved zinc finger domains in which the zinc ion is coordinated by four cysteine residues. NMR studies have shown that the core of the zinc finger comprises two irregular anti-parallel beta-sheets and an alpha-helix followed by a long loop to the C-terminal end of the finger. The N-terminus, which includes the helix, is similar in structure, but not sequence, to the N-terminal zinc module of the glucocorticoid receptor DNA binding domain. The helix and the loop connecting the two beta-sheets interact with the major groove of the DNA, while the C-terminal tail wraps around into the minor groove. It is this tail that is the essential determinant of specific binding. Interactions between the zinc finger and DNA are mainly hydrophobic, explaining the preponderance of thymines in the binding site. A large number of interactions with the phosphate backbone have also been observed. Two GATA zinc fingers are found in the GATA transcription factors. However there are several proteins which only contain a single copy of the domain. SEQ ID NO:322 and SEQ ID NO:424 set forth the amino acid sequences of DNA clones, identified herein as Ceres CLONE ID no. 303140 (SEQ ID NO:321) and Ceres CLONE ID no. 36927 (SEQ ID NO:423), respectively, each of which is predicted to encode a GATA-binding transcription factor polypeptide.

In some cases, a regulatory protein containing a GATA domain can also contain a CCT motif and a ZIM motif. The CCT (CONSTANS, CO-like, and TOC1) domain is a highly conserved motif that is rich in basic amino acids. The second half of the CCT motif contains a putative nuclear localization signal and has been shown to be involved in nuclear localization. In addition, the CCT domain may have a role in polypeptide-polypeptide interaction. The CCT domain is found near the C-terminus of plant polypeptides, many of which are involved in light signal transduction. Other domains, such as the B-box zinc finger, the GATA-type zinc finger, the ZIM motif or the response regulatory domain, are found in association with the CCT domain. The ZIM motif is found in a variety of plant transcription factors that contain GATA domains and other motifs. The most conserved amino acids form the pattern TIFF/YXG. The ZIM domain may be involved in DNA binding. SEQ ID NO:136 and SEQ ID NO:218 set forth the amino acid sequences of DNA clones, identified herein as Ceres CLONE ID no. 119104 (SEQ ID NO:135) and Ceres CLONE ID no. 20769 (SEQ ID NO:217), respectively, each of which is predicted to encode a polypeptide containing a GATA domain, a CCT motif, and a ZIM motif.

In some cases, a regulatory protein can contain a zf-AN1 domain characteristic of an AN1-like zinc finger transcription factor polypeptide. The zf-AN1 domain was first identified as a zinc finger at the C-terminus of An1, a ubiquitin-like protein in Xenopus laevis. The following pattern describes the zinc finger: C-X2-C-X(9-12)-C-X(1-2)-C-X4-C-X2-H-X5-H-X-C, where X can be any amino acid, and the numbers in brackets indicate the number of residues. SEQ ID NO:119 sets forth the amino acid sequence of a DNA clone, identified herein as Ceres CLONE ID no. 11130 (SEQ ID NO:118), that is predicted to encode a zinc finger transcription factor polypeptide having a zf-AN1 domain.

In some cases, a regulatory protein having a zf-AN1 domain can also have a zf-A20 domain. A20 (an inhibitor of cell death)-like zinc fingers are believed to mediate self-association in A20. These fingers also mediate IL-1-induced NF-kappa B activation. SEQ ID NO:69 and SEQ ID NO:505 set forth the amino acid sequences of DNA clones, referred to herein as Ceres CDNA ID no. 23538950 (SEQ ID NO:68) and Ceres CLONE ID no. 45 (SEQ ID NO:504), respectively, each of which is predicted to encode a zinc finger transcription factor polypeptide having a zf-AN1 domain and a zf-A20 domain.

In some cases, a regulatory protein can contain one or more zf-C2H2 domains characteristic of C2H2 type zinc finger transcription factor polypeptides. C2H2 zinc-finger family polypeptides play important roles in plant development including floral organogenesis, leaf initiation, lateral shoot initiation, gametogenesis, and seed development. SEQ ID NO:71 sets forth the amino acid sequence of a DNA clone, identified herein as Ceres CDNA ID no. 23544617 (SEQ ID NO:70), that is predicted to encode a polypeptide containing a zf-C2H2 domain. SEQ ID NO:47 sets forth the amino acid sequence of a DNA clone, identified herein as Ceres CDNA ID no. 23515088 (SEQ ID NO:46), that is predicted to encode a C2H2 zinc-finger polypeptide containing two zf-C2H2 domains.

In some cases, a regulatory protein can contain a zf-DHHC domain. The DHHC zinc finger domain, also known as NEW1, is predicted to be a zinc binding domain involved in polypeptide-polypeptide or polypeptide-DNA interactions, and palmitoyltransferase activity. SEQ ID NO:200 sets forth the amino acid sequence of a DNA clone, identified herein as Ceres CLONE ID no. 19340 (SEQ ID NO:199), that is predicted to encode a polypeptide containing a zf-DHHC domain.

In some cases, a regulatory protein can contain a zf-Dof domain characteristic of a Dof domain zinc finger transcription factor polypeptide. Dof (DNA binding with one finger) domain polypeptides are plant-specific transcription factor polypeptides having a highly conserved DNA binding domain. A Dof domain is a zinc finger DNA binding domain that resembles the Cys2 zinc finger, although it has a longer putative loop containing an extra Cys residue that is conserved. AOBP, a DNA binding polypeptide in pumpkin (Cucurbita maxima), contains a 52 amino acid Dof domain, which is highly conserved in several DNA binding polypeptides of higher plants. SEQ ID NO:106 sets forth the amino acid sequence of a DNA clone, identified herein as Ceres CLONE ID no. 103581 (SEQ ID NO:105), that is predicted to encode a D of domain zinc finger transcription factor polypeptide.

In some cases, a regulatory protein can contain a zf-Tim10_DDP domain characteristic of a Tim10/DDP family zinc finger polypeptide. Members of the Tim10/DDP family contain a putative zinc binding domain with four conserved cysteine residues. The zf-Tim10_DDP domain is found in the human disease polypeptide Deafness Dystonia Protein 1. Members of the Tim10/DDP family, such as Tim9 and Tim10, are involved in mitochondrial polypeptide import. SEQ ID NO:229 sets forth the amino acid sequence of a DNA clone, identified herein as Ceres CLONE ID no. 21075 (SEQ ID NO:228), that is predicted to encode a Tim10/DDP family zinc finger polypeptide.

In some cases, a regulatory protein can contain a zf-TRAF domain characteristic of a TRAF-type zinc finger polypeptide. Members of the tumor necrosis factor receptor-associated factor (TRAF) polypeptide family are involved in activation of NF-κB, JNK, and p38 triggered by tumor necrosis factor (TNF) receptor family members and toll/interleukin-1 receptor (TIR) domain-containing receptors. TRAF polypeptides share a C-terminal homology region termed the TRAF domain that is capable of binding to the cytoplasmic domain of receptors and to other TRAF polypeptides. TRAF polypeptides are thought to be important regulators of cell death and cellular responses to stress. SEQ ID NO:58 sets forth the amino acid sequence of a DNA clone, identified herein as Ceres CDNA ID no. 23529806 (SEQ ID NO:57), that is predicted to encode a polypeptide containing a zf-TRAF domain.

In some cases, a regulatory protein can contain a putative zinc finger in N-recognin (zf-UBR1) domain and a PHD finger. The putative zinc finger in N-recognin domain is a recognition component of the N-end rule pathway. The N-end rule-based degradation signal, which targets a polypeptide for ubiquitin-dependent proteolysis, comprises a destabilizing amino-terminal residue and a specific internal lysine residue. The homeodomain (PHD) finger is a C4HC3 zinc-finger-like motif found in nuclear polypeptides thought to be involved in chromatin-mediated transcriptional regulation. The PHD finger motif is reminiscent of, but distinct from, the C3HC4 type RING finger. Similar to the RING finger and the LIM domain, the PHD finger is thought to bind two zinc ions. The PHD finger could be involved in polypeptide-polypeptide interactions and assembly or activity of multicomponent complexes involved in transcriptional activation or repression. The interactions could also be intra-molecular and important in maintaining the structural integrity of the polypeptide. SEQ ID NO:39 sets forth the amino acid sequence of a DNA clone, identified herein as Ceres CDNA ID no. 23503138 (SEQ ID NO:38), that is predicted to encode a polypeptide containing a zf-UBR1 domain and a PHD finger.

A regulatory protein can comprise the amino acid sequence set forth in SEQ ID NO:29, SEQ ID NO:51, SEQ ID NO:113, SEQ ID NO:129, SEQ ID NO:141, SEQ ID NO:149, SEQ ID NO:277, SEQ ID NO:368, SEQ ID NO:391, SEQ ID NO:576, SEQ ID NO:585, SEQ ID NO:599, SEQ ID NO:676, SEQ ID NO:770, SEQ ID NO:688, SEQ ID NO:701, SEQ ID NO:171, SEQ ID NO:206, SEQ ID NO:131, SEQ ID NO:192, SEQ ID NO:832, SEQ ID NO:322, SEQ ID NO:424, SEQ ID NO:136, SEQ ID NO:218, SEQ ID NO:119, SEQ ID NO:69, SEQ ID NO:505, SEQ ID NO:71, SEQ ID NO:47, SEQ ID NO:200, SEQ ID NO:106, SEQ ID NO:229, SEQ ID NO:58, or SEQ ID NO:39. Alternatively, a regulatory protein can be a homolog, ortholog, or variant of the polypeptide having the amino acid sequence set forth in SEQ ID NO:29, SEQ ID NO:51, SEQ ID NO:113, SEQ ID NO:129, SEQ ID NO:141, SEQ ID NO:149, SEQ ID NO:277, SEQ ID NO:368, SEQ ID NO:391, SEQ ID NO:576, SEQ ID NO:585, SEQ ID NO:599, SEQ ID NO:676, SEQ ID NO:770, SEQ ID NO:688, SEQ ID NO:701, SEQ ID NO:171, SEQ ID NO:206, SEQ ID NO:131, SEQ ID NO:192, SEQ ID NO:832, SEQ ID NO:322, SEQ ID NO:424, SEQ ID NO:136, SEQ ID NO:218, SEQ ID NO:119, SEQ ID NO:69, SEQ ID NO:505, SEQ ID NO:71, SEQ ID NO:47, SEQ ID NO:200, SEQ ID NO:106, SEQ ID NO:229, SEQ ID NO:58, or SEQ ID NO:39. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:29, SEQ ID NO:51, SEQ ID NO:113, SEQ ID NO:129, SEQ ID NO:141, SEQ ID NO:149, SEQ ID NO:277, SEQ ID NO:368, SEQ ID NO:391, SEQ ID NO:576, SEQ ID NO:585, SEQ ID NO:599, SEQ ID NO:676, SEQ ID NO:770, SEQ ID NO:688, SEQ ID NO:701, SEQ ID NO:171, SEQ ID NO:206, SEQ ID NO:131, SEQ ID NO:192, SEQ ID NO:832, SEQ ID NO:322, SEQ ID NO:424, SEQ ID NO:136, SEQ ID NO:218, SEQ ID NO:119, SEQ ID NO:69, SEQ ID NO:505, SEQ ID NO:71, SEQ ID NO:47, SEQ ID NO:200, SEQ ID NO:106, SEQ ID NO:229, SEQ ID NO:58, or SEQ ID NO:39.

Amino acid sequences of homologs and/or orthologs of the polypeptide having the amino acid sequence set forth in SEQ ID NO:29, SEQ ID NO:141, SEQ ID NO:277, SEQ ID NO:368, SEQ ID NO:391, SEQ ID NO:576, SEQ ID NO:599, SEQ ID NO:676, SEQ ID NO:206, SEQ ID NO:131, SEQ ID NO:192, SEQ ID NO:424, SEQ ID NO:136, SEQ ID NO:218, SEQ ID NO:119, SEQ ID NO:505, SEQ ID NO:47, SEQ ID NO:200, SEQ ID NO:229, and SEQ ID NO:58 are provided in FIG. 5, FIG. 22, FIG. 40, FIG. 58, FIG. 61, FIG. 88, FIG. 91, FIG. 103, FIG. 31, FIG. 20, FIG. 29, FIG. 68, FIG. 21, FIG. 33, FIG. 18, FIG. 79, FIG. 7, FIG. 30, FIG. 35, and FIG. 9, respectively. Each of FIG. 5, FIG. 22, FIG. 40, FIG. 58, FIG. 61, FIG. 88, FIG. 91, FIG. 103, FIG. 31, FIG. 20, FIG. 29, FIG. 68, FIG. 21, FIG. 33, FIG. 18, FIG. 79, FIG. 7, FIG. 30, FIG. 35, and FIG. 9 also includes a consensus amino acid sequence determined by aligning homologous and/or orthologous amino acid sequences with the amino acid sequence set forth in SEQ ID NO:29, SEQ ID NO:141, SEQ ID NO:277, SEQ ID NO:368, SEQ ID NO:391, SEQ ID NO:576, SEQ ID NO:599, SEQ ID NO:676, SEQ ID NO:206, SEQ ID NO:131, SEQ ID NO:192, SEQ ID NO:424, SEQ ID NO:136, SEQ ID NO:218, SEQ ID NO:119, SEQ ID NO:505, SEQ ID NO:47, SEQ ID NO:200, SEQ ID NO:229, or SEQ ID NO:58, respectively.

Figure 5:
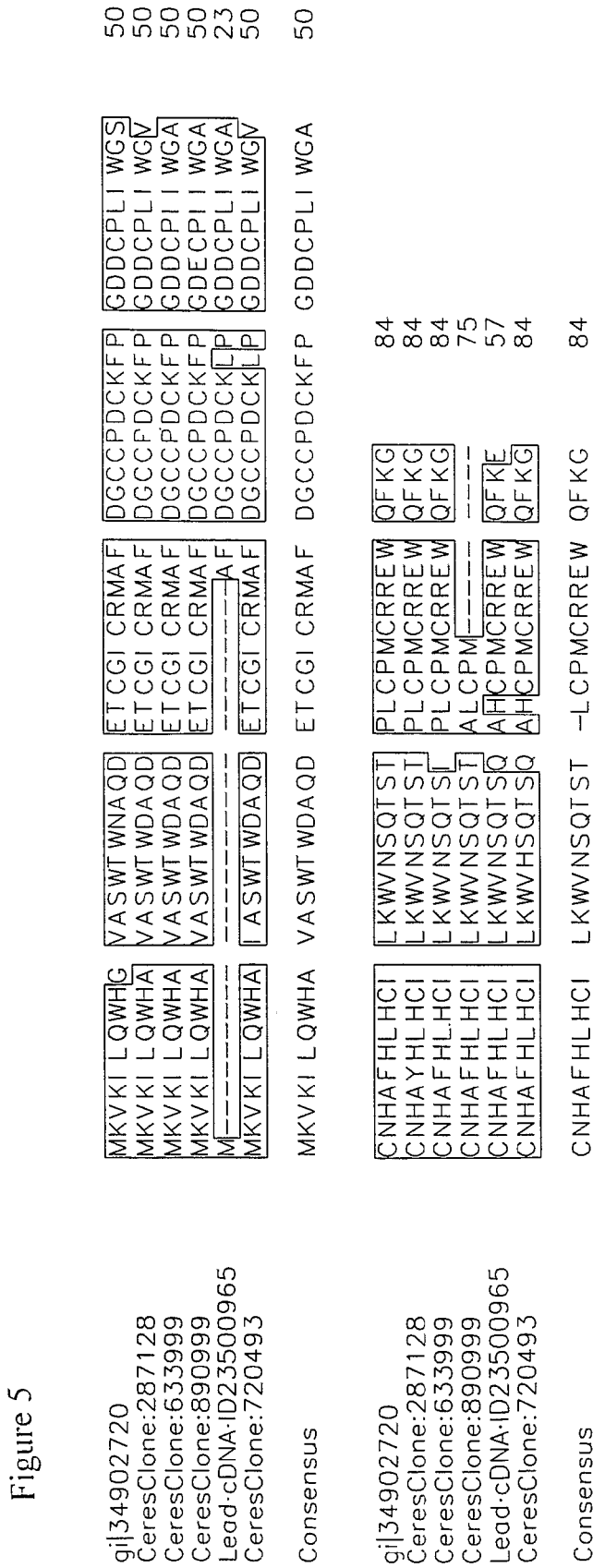
FIG. 5 is an alignment of the amino acid sequence of Lead CDNA ID 23500965 (SEQ ID NO:29) with homologous and/or orthologous amino acid sequences CeresClone:720493 (SEQ ID NO:30), gi|34902720 (SEQ ID NO:31), CeresClone:633999 (SEQ ID NO:32), CeresClone:890999 (SEQ ID NO:33), and CeresClone:287128 (SEQ ID NO:34). The consensus sequence determined by the alignment is set forth.
Figure 15:
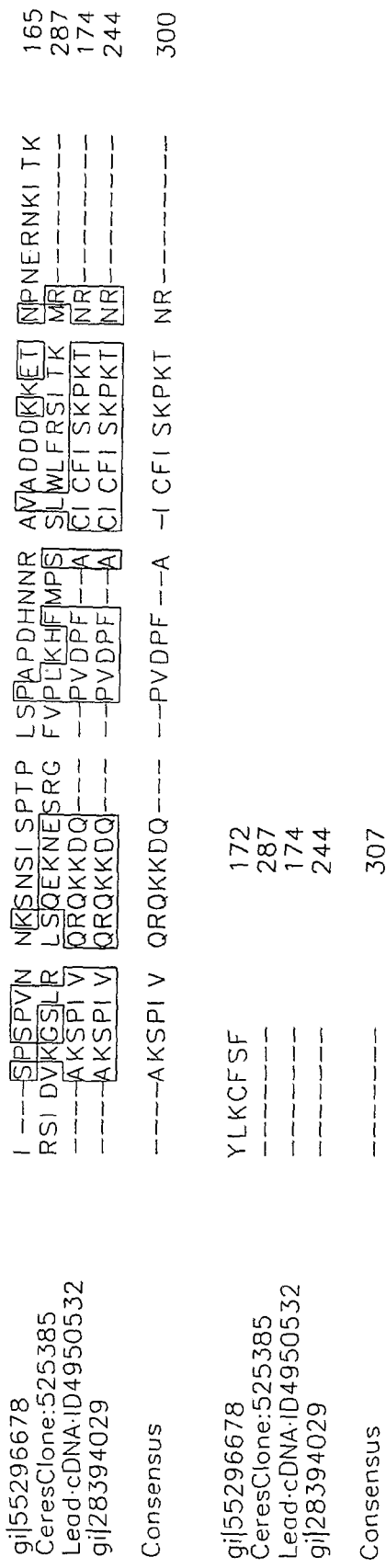
FIG. 15 is an alignment of the amino acid sequence of Lead CDNA ID 4950532 (SEQ ID NO:99) with homologous and/or orthologous amino acid sequences gi|28394029 (SEQ ID NO:100), CeresClone:525385 (SEQ ID NO:101), and gi|55296678 (SEQ ID NO:102). The consensus sequence determined by the alignment is set forth.

For example, the alignment in FIG. 5 provides the amino acid sequences of Lead CDNA ID 23500965 (SEQ ID NO:29), CeresClone:720493 (SEQ ID NO:30), gi|34902720 (SEQ ID NO:31), CeresClone:633999 (SEQ ID NO:32), CeresClone:890999 (SEQ ID NO:33), and CeresClone:287128 (SEQ ID NO:34).

The alignment in FIG. 22 provides the amino acid sequences of Lead CeresClone 119104 (SEQ ID NO:136), CeresClone:337006 (SEQ ID NO:137), CeresClone:220709 (SEQ ID NO:138), and gi|53792087 (SEQ ID NO:139).

The alignment in FIG. 40 provides the amino acid sequences of Lead CeresClone 232985 (SEQ ID NO:277), CeresClone:304618 (SEQ ID NO:278) and gi|34898016 (SEQ ID NO:279).

The alignment in FIG. 58 provides the amino acid sequences of Lead CeresClone 335471 (SEQ ID NO:368), CeresClone:226047 (SEQ ID NO:369), gi|33589800 (SEQ ID NO:370), CeresClone:1044196 (SEQ ID NO:371), and CeresClone:471303 (SEQ ID NO:372).

The alignment in FIG. 61 provides the amino acid sequences of Lead CeresClone 336888 (SEQ ID NO:391) and gi|46931308 (SEQ ID NO:392).

The alignment in FIG. 88 provides the amino acid sequences of Lead CeresClone 560731 (SEQ ID NO:576), CeresClone:4267 (SEQ ID NO:577) and CeresClone:1377336 (SEQ ID NO:578).

The alignment in FIG. 91 provides the amino acid sequences of Lead CeresClone 7201 (SEQ ID NO:599), CeresClone:40916 (SEQ ID NO:600), CeresClone:879445 (SEQ ID NO:601), and CeresClone:294406 (SEQ ID NO:602).

The alignment in FIG. 103 provides the amino acid sequences of Lead CeresClone 21863 (SEQ ID NO:676) and gi|34902106 (SEQ ID NO:677).

Figure 31:
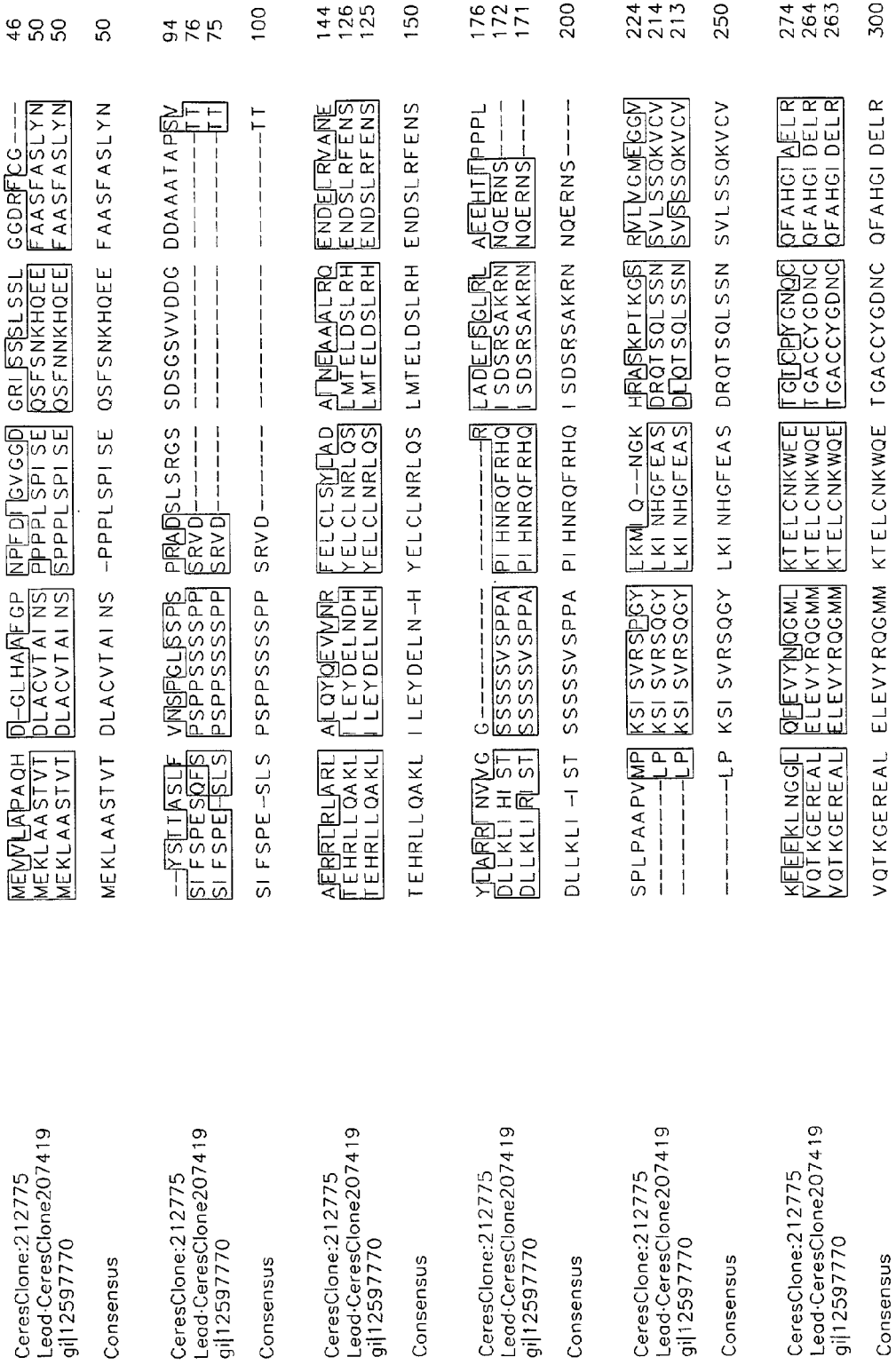
FIG. 31 is an alignment of the amino acid sequence of Lead CeresClone 207419 (SEQ ID NO:206) with homologous and/or orthologous amino acid sequences gi|12597770 (SEQ ID NO:207) and CeresClone:212775 (SEQ ID NO:208). The consensus sequence determined by the alignment is set forth.

The alignment in FIG. 31 provides the amino acid sequences of Lead CeresClone 207419 (SEQ ID NO:206), gi|12597770 (SEQ ID NO:207) and CeresClone:212775 (SEQ ID NO:208).

The alignment in FIG. 20 provides the amino acid sequences of Lead CeresClone 117089 (SEQ ID NO:131), gi|50907243 (SEQ ID NO:132), CeresClone:478779 (SEQ ID NO:133), and CeresClone:634320 (SEQ ID NO:134).

The alignment in FIG. 29 provides the amino acid sequences of Lead CeresClone 17632 (SEQ ID NO:192), gi|9294110 (SEQ ID NO:193), CeresClone:975540 (SEQ ID NO:194), CeresClone:473410 (SEQ ID NO:195), CeresClone:703717 (SEQ ID NO:196), CeresClone:1459706 (SEQ ID NO:197), and gi|50905911 (SEQ ID NO:198).

The alignment in FIG. 68 provides the amino acid sequences of Lead CeresClone 36927 (SEQ ID NO:424) and gi|37572445 (SEQ ID NO:425).

The alignment in FIG. 21 provides the amino acid sequences of Lead CeresClone 119104 (SEQ ID NO:136), CeresClone:337006 (SEQ ID NO:137), CeresClone:220709 (SEQ ID NO:138), and gi|53792087 (SEQ ID NO:139).

The alignment in FIG. 33 provides the amino acid sequences of Lead CeresClone 20769 (SEQ ID NO:218), CeresClone:477718 (SEQ ID NO:219) and CeresClone: 518521 (SEQ ID NO:220).

The alignment in FIG. 18 provides the amino acid sequences of Lead CeresClone 11130 (SEQ ID NO:119), gi|1994583 (SEQ ID NO:120), CeresClone:592400 (SEQ ID NO:121), and gi|50900102 (SEQ ID NO:122).

The alignment in FIG. 79 provides the amino acid sequences of Lead CeresClone 45 (SEQ ID NO:505), CeresClone:962327 (SEQ ID NO:506) and CeresClone:1360570 (SEQ ID NO:507).

The alignment in FIG. 7 provides the amino acid sequences of Lead CDNA ID 23515088 (SEQ ID NO:47), gi|861091 (SEQ ID NO:48) and gi|2346972 (SEQ ID NO:49).

The alignment in FIG. 30 provides the amino acid sequences of Lead CeresClone 19340 (SEQ ID NO:200), CeresClone:573293 (SEQ ID NO:201), CeresClone:537080 (SEQ ID NO:202), gi|50919203 (SEQ ID NO:203), and CeresClone:230342 (SEQ ID NO:204).

The alignment in FIG. 35 provides the amino acid sequences of Lead CeresClone 21075 (SEQ ID NO:229), gi|14030607 (SEQ ID NO:230), gi|5107082 (SEQ ID NO:231), CeresClone:392743 (SEQ ID NO:232), CeresClone:1090803 (SEQ ID NO:233), CeresClone:946808 (SEQ ID NO:234), CeresClone:1086365 (SEQ ID NO:235), CeresClone:373100 (SEQ ID NO:236), CeresClone: 1323425 (SEQ ID NO:237), CeresClone:617980 (SEQ ID NO:238), gi|50251897 (SEQ ID NO:239), gi|5107149 (SEQ ID NO:240), gi|50928231 (SEQ ID NO:241), CeresClone: 714267 (SEQ ID NO:242), and CeresClone:584348 (SEQ ID NO:243).

The alignment in FIG. 9 provides the amino acid sequences of Lead cDNA ID 23529806 (SEQ ID NO:58), gi|21593788 (SEQ ID NO:59), CeresClone:969293 (SEQ ID NO:60), CeresClone:852336 (SEQ ID NO:61), CeresClone:234649 (SEQ ID NO:62), CeresClone:460881 (SEQ ID NO:63), and gi|50939745 (SEQ ID NO:64).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 30-34, SEQ ID NO:142, SEQ ID NOs:278-279, SEQ ID NOs:369-372, SEQ ID NO:392, SEQ ID NOs:577-578, SEQ ID NOs:600-602, SEQ ID NO:677, SEQ ID NO:207-208, SEQ ID NOs:132-134, SEQ ID NOs:193-198, SEQ ID NO:425, SEQ ID NOs:137-139, SEQ ID NOs:219-220, SEQ ID NOs:120-122, SEQ ID NOs:506-507, SEQ ID NOs:48-49, SEQ ID NOs:201-204, SEQ ID NOs:230-243, SEQ ID NOs:59-64, or the consensus sequence set forth in FIG. 5, FIG. 22, FIG. 40, FIG. 58, FIG. 61, FIG. 88, FIG. 91, FIG. 103, FIG. 31, FIG. 20, FIG. 29, FIG. 68, FIG. 21, FIG. 33, FIG. 18, FIG. 79, FIG. 7, FIG. 30, FIG. 35, or FIG. 9.

A regulatory protein can contain an AP2 domain characteristic of polypeptides belonging to the AP2/EREBP family of plant transcription factor polypeptides. AP2 (APETALA2) and EREBPs (ethylene-responsive element binding proteins) are prototypic members of a family of transcription factors unique to plants, whose distinguishing characteristic is that they contain the so-called AP2 DNA binding domain. AP2/EREBP genes form a large multigene family encoding polypeptides that play a variety of roles throughout the plant life cycle: from being key regulators of several developmental processes, such as floral organ identity determination and control of leaf epidermal cell identity, to forming part of the mechanisms used by plants to respond to various types of biotic and environmental stress. SEQ ID NO:144, SEQ ID NO:296, SEQ ID NO:331, SEQ ID NO:496, SEQ ID NO:524, SEQ ID NO:587, SEQ ID NO:597, SEQ ID NO:611, and SEQ ID NO:622 set forth the amino acid sequences of DNA clones, identified herein as Ceres CLONE ID no. 123905 (SEQ ID NO:143), Ceres CLONE ID no. 26867 (SEQ ID NO:295), Ceres CLONE ID no. 31252 (SEQ ID NO:330), Ceres CLONE ID no. 42960 (SEQ ID NO:495), Ceres CLONE ID no. 481710 (SEQ ID NO:523), Ceres CLONE ID no. 625627 (SEQ ID NO:586), Ceres CLONE ID no. 691319 (SEQ ID NO:596), Ceres CLONE ID no. 92102 (SEQ ID NO:610), and Ceres CLONE ID no. 969750 (SEQ ID NO:621), respectively, each of which is predicted to encode a polypeptide containing an AP2 domain.

A regulatory protein can comprise the amino acid sequence set forth in SEQ ID NO:144, SEQ ID NO:296, SEQ ID NO:331, SEQ ID NO:496, SEQ ID NO:524, SEQ ID NO:587, SEQ ID NO:597, SEQ ID NO:611, or SEQ ID NO:622. Alternatively, a regulatory protein can be a homolog, ortholog, or variant of the polypeptide having the amino acid sequence set forth in SEQ ID NO:144, SEQ ID NO:296, SEQ ID NO:331, SEQ ID NO:496, SEQ ID NO:524, SEQ ID NO:587, SEQ ID NO:597, SEQ ID NO:611, or SEQ ID NO:622. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:144, SEQ ID NO:296, SEQ ID NO:331, SEQ ID NO:496, SEQ ID NO:524, SEQ ID NO:587, SEQ ID NO:597, SEQ ID NO:611, or SEQ ID NO:622.

Figure 23:
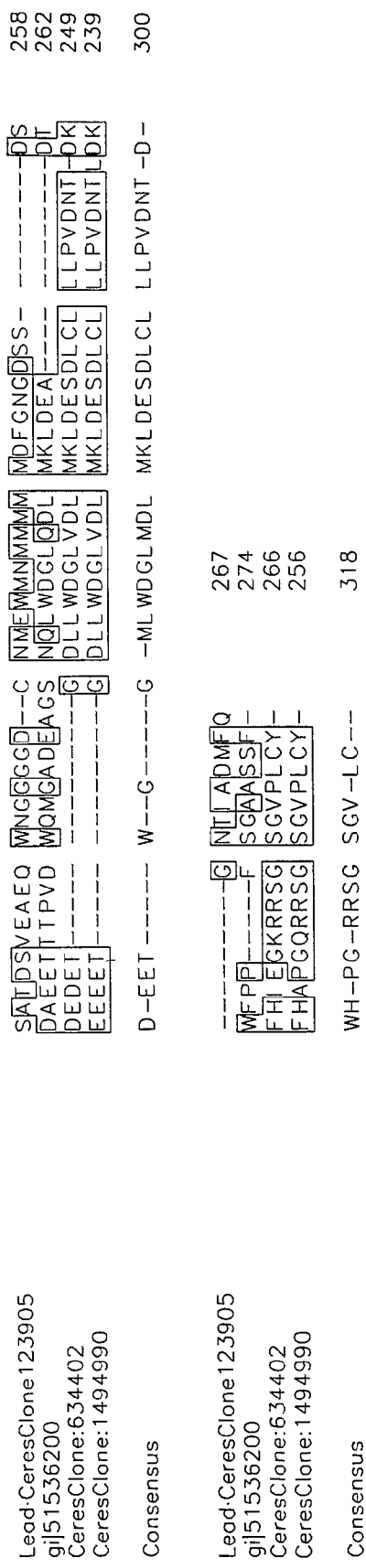
FIG. 23 is an alignment of the amino acid sequence of Lead CeresClone 123905 (SEQ ID NO:144) with homologous and/or orthologous amino acid sequences CeresClone:634402 (SEQ ID NO:145), CeresClone:1494990 (SEQ ID NO:146), and gi|51536200 (SEQ ID NO:147). The consensus sequence determined by the alignment is set forth.

Amino acid sequences of homologs and/or orthologs of the polypeptide having the amino acid sequence set forth in SEQ ID NO:144, SEQ ID NO:496, and SEQ ID NO:524 are provided in FIG. 23, FIG. 78, and FIG. 82, respectively. Each of FIG. 23, FIG. 78, and FIG. 82 also includes a consensus amino acid sequence determined by aligning homologous and/or orthologous amino acid sequences with the amino acid sequence set forth in SEQ ID NO:144, SEQ ID NO:496, or SEQ ID NO:524, respectively.

For example, the alignment in FIG. 23 provides the amino acid sequences of Lead CeresClone 123905 (SEQ ID NO:144), CeresClone:634402 (SEQ ID NO:145), CeresClone:1494990 (SEQ ID NO:146), and gi|51536200 (SEQ ID NO:147).

The alignment in FIG. 78 provides the amino acid sequences of Lead CeresClone 42960 (SEQ ID NO:496), gi|33331083 (SEQ ID NO:497), gi|62526569 (SEQ ID NO:498), gi|37954364 (SEQ ID NO:499), gi|22074046 (SEQ ID NO:500), gi|30961941 (SEQ ID NO:501), gi|38343926 (SEQ ID NO:502), and gi|57117316 (SEQ ID NO:503).

The alignment in FIG. 82 provides the amino acid sequences of Lead CeresClone 481710 (SEQ ID NO:524), CeresClone:1620272 (SEQ ID NO:525), gi|37147896 (SEQ ID NO:526), gi|45826358 (SEQ ID NO:527), gi|41351817 (SEQ ID NO:528), gi|12003382 (SEQ ID NO:529), CeresClone:1052602 (SEQ ID NO:530), gi|12003384 (SEQ ID NO:531), gi|5616086 (SEQ ID NO:532), gi|38426952 (SEQ ID NO:533), gi|38426948 (SEQ ID NO:534), gi|49658405 (SEQ ID NO:535), gi|38146944 (SEQ ID NO:536), gi|10177734 (SEQ ID NO:537), and gi|38683266 (SEQ ID NO:538).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs:

145-147, SEQ ID NOs:497-503, SEQ ID NOs:525-538, or the consensus sequence set forth in FIG. 23, FIG. 78, or FIG. 82.

A regulatory protein can have an HLH (helix-loop-helix) DNA binding domain characteristic of basic-helix-loop-helix (bHLH) transcription factors. Basic-helix-loop-helix transcription factors belong to a family of transcriptional regulators present in eukaryotes. Many different functions have been identified for bHLH transcription factors in animals, including control of cell proliferation and development of specific cell lineages. In plants, bHLH transcription factors are thought to have various roles in plant cell and tissue development as well as plant metabolism. The mechanism whereby bHLH transcription factors control gene transcription often involves homo- or hetero-dimerization. Basic-helix-loop-helix transcription factors constitute one of the largest families of transcription factors in *Arabidopsis thaliana*. Comparisons with animal sequences suggest that the majority of plant bHLH genes have evolved from the ancestral group B class of bHLH genes. Twelve sub-families have been identified. Within each of these main groups, there are conserved amino acid sequence motifs outside the DNA binding domain. SEQ ID NO:36, SEQ ID NO:43, SEQ ID NO:73, SEQ ID NO:84, SEQ ID NO:302, SEQ ID NO:483, SEQ ID NO:566, SEQ ID NO:748, SEQ ID NO:750, SEQ ID NO:699, and SEQ ID NO:640, set forth the amino acid sequences of DNA clones, identified herein as Ceres CDNA ID no. 23500996 (SEQ ID NO:35), Ceres CDNA ID no. 23509939 (SEQ ID NO:42), Ceres CDNA ID no. 23544687 (SEQ ID NO:72), Ceres CDNA ID no. 23629711 (SEQ ID NO:83), Ceres CLONE ID no. 27793 (SEQ ID NO:301), Ceres CLONE ID no. 40736 (SEQ ID NO:482), Ceres CLONE ID no. 560681 (SEQ ID NO:565), Ceres CLONE ID no. 151587 (SEQ ID NO:747), Ceres CLONE ID no. 159557 (SEQ ID NO:749), Ceres CLONE ID no. 35890 (SEQ ID NO:698), and Ceres CLONE ID no. 4346 (SEQ ID NO:639), respectively, each of which is predicted to encode a polypeptide having an HLH DNA binding domain.

A regulatory protein can comprise the amino acid sequence set forth in SEQ ID NO:36, SEQ ID NO:43, SEQ ID NO:73, SEQ ID NO:84, SEQ ID NO:302, SEQ ID NO:483, SEQ ID NO:566, SEQ ID NO:748, SEQ ID NO:750, SEQ ID NO:699, or SEQ ID NO:640. Alternatively, a regulatory protein can be a homolog, ortholog, or variant of the polypeptide having the amino acid sequence set forth in SEQ ID NO:36, SEQ ID NO:43, SEQ ID NO:73, SEQ ID NO:84, SEQ ID NO:302, SEQ ID NO:483, SEQ ID NO:566, SEQ ID NO:748, SEQ ID NO:750, SEQ ID NO:699, or SEQ ID NO:640. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:36, SEQ ID NO:43, SEQ ID NO:73, SEQ ID NO:84, SEQ ID NO:302, SEQ ID NO:483, SEQ ID NO:566, SEQ ID NO:748, SEQ ID NO:750, SEQ ID NO:699, or SEQ ID NO:640.

Amino acid sequences of homologs and/or orthologs of the polypeptide having the amino acid sequence set forth in SEQ ID NO:36, SEQ ID NO:73, SEQ ID NO:302, SEQ ID NO:483, and SEQ ID NO:566 are provided in FIG. 6, FIG. 11, FIG. 44, FIG. 76, and FIG. 87, respectively. Each of FIG. 6, FIG. 11, FIG. 44, FIG. 76, and FIG. 87 also includes a consensus amino acid sequence determined by aligning homologous and/or orthologous amino acid sequences with the amino acid sequence set forth in SEQ ID NO:36, SEQ ID NO:73, SEQ ID NO:302, SEQ ID NO:483, or SEQ ID NO:566, respectively.

For example, the alignment in FIG. 6 provides the amino acid sequences of Lead CDNA ID 23500996 (SEQ ID NO:36) and CeresClone:545208 (SEQ ID NO:37).

The alignment in FIG. 11 provides the amino acid sequences of Lead CDNA ID 23544687 (SEQ ID NO:73) and CeresClone:474183 (SEQ ID NO:74).

The alignment in FIG. 44 provides the amino acid sequences of Lead CeresClone 27793 (SEQ ID NO:302) and CeresClone:522644 (SEQ ID NO:303).

The alignment in FIG. 76 provides the amino acid sequences of Lead CeresClone 40736 (SEQ ID NO:483), gi|20127109 (SEQ ID NO:484), CeresClone:590996 (SEQ ID NO:485), and CeresClone:631135 (SEQ ID NO:486).

The alignment in FIG. 87 provides the amino acid sequences of Lead CeresClone 560681 (SEQ ID NO:566), gi|9294226 (SEQ ID NO:567), CeresClone:951040 (SEQ ID NO:568), CeresClone:966938 (SEQ ID NO:569), CeresClone:560948 (SEQ ID NO:570), CeresClone:653656 (SEQ ID NO:571), CeresClone:663844 (SEQ ID NO:572), CeresClone:280170 (SEQ ID NO:573), and gi|50912765 (SEQ ID NO:574).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NO:37, SEQ ID NO:74, SEQ ID NO:303, SEQ ID NOs:484-486, SEQ ID NOs:567-574, or the consensus sequence set forth in FIG. 6, FIG. 11, FIG. 44, FIG. 76, or FIG. 87.

A regulatory protein can have one or more domains characteristic of a basic-leucine zipper (bZIP) transcription factor polypeptide. For example, a regulatory protein can have a bZIP_1 domain. The bZIP transcription factor polypeptides of eukaryotes contain a basic region mediating sequence-specific DNA binding and a leucine zipper region that is required for dimerization. In plants, bZIP transcription factors regulate processes including pathogen defense, light and stress signaling, seed maturation and flower development. The *Arabidopsis* genome sequence contains at least 70 distinct members of the bZIP family. SEQ ID NO:27, SEQ ID NO:80, SEQ ID NO686, and SEQ ID NO:826 set forth the amino acid sequences of DNA clones, identified herein as Ceres CDNA ID no. 23499985 (SEQ ID NO:26), Ceres CDNA ID no. 23557940 (SEQ ID NO:79), Ceres CLONE no. 33016 (SEQ ID NO:685), and Ceres CLONE no. 566161 (SEQ ID NO:825), respectively, each of which is predicted to encode a polypeptide containing a bZIP$_{-1}$ domain.

In some cases, a regulatory protein can contain a bZIP_2 domain characteristic of a bZIP transcription factor polypeptide. SEQ ID NO:405, SEQ ID NO:595, and SEQ ID NO:690 set forth the amino acid sequences of DNA clones, identified herein as Ceres CLONE ID no. 35429 (SEQ ID NO:404), Ceres CLONE ID no. 674157 (SEQ ID NO:594), and Ceres CLONE no. 34553 (SEQ ID NO:689), respectively, each of which is predicted to encode a polypeptide containing a bZIP_2 domain.

In some cases, a regulatory protein can contain a bZIP_1 domain and a bZIP_2 domain. SEQ ID NO:589 sets forth the amino acid sequence of a DNA clone, identified herein as Ceres CLONE ID no. 6568 (SEQ ID NO:588), that is predicted to encode a polypeptide containing a bZIP_1 domain and a bZIP_2 domain.

In some cases, a regulatory protein can have a bZIP_Maf domain and an MFMR domain, both of which are characteristic of basic region leucine zipper (bZIP) domain-containing transcription factor polypeptides. The Maf family of basic region leucine zipper (bZIP) domain-containing transcription factor polypeptides may be related to bZIP_1. An MFMR region is found in the N-terminus of the bZIP_1 transcription factor domain. The N-terminal half is rich in proline residues and has been termed the PRD (proline rich domain). The C-terminal half is more polar and has been called the MFMR (multifunctional mosaic region). SEQ ID NO:53 sets forth the amino acid sequence of a DNA clone, identified herein as cDNA ID 23522373 (SEQ ID NO:52), that is predicted to encode a transcription factor polypeptide having a bZIP_Maf domain and an MFMR domain.

A regulatory protein can comprise the amino acid sequence set forth in SEQ ID NO:27, SEQ ID NO:80, SEQ ID NO686, SEQ ID NO:826, SEQ ID NO:405, SEQ ID NO:595, SEQ ID NO:690, SEQ ID NO:589, or SEQ ID NO:53. Alternatively, a regulatory protein can be a homolog, ortholog, or variant of the polypeptide having the amino acid sequence set forth in SEQ ID NO:27, SEQ ID NO:80, SEQ ID NO:686, SEQ ID NO:826, SEQ ID NO:405, SEQ ID NO:595, SEQ ID NO:690, SEQ ID NO:589, or SEQ ID NO:53. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:27, SEQ ID NO:80, SEQ ID NO686, SEQ ID NO:826, SEQ ID NO:405, SEQ ID NO:595, SEQ ID NO:690, SEQ ID NO:589, or SEQ ID NO:53.

Amino acid sequences of homologs and/or orthologs of the polypeptide having the amino acid sequence set forth in SEQ ID NO:80, SEQ ID NO:405, SEQ ID NO:690, SEQ ID NO:589, and SEQ ID NO:53 are provided in FIG. 12, FIG. 64, FIG. 104, FIG. 90, and FIG. 8, respectively. Each of FIG. 12, FIG. 64, FIG. 104, FIG. 90, and FIG. 8 also includes a consensus amino acid sequence determined by aligning homologous and/or orthologous amino acid sequences with the amino acid sequence set forth in SEQ ID NO:80, SEQ ID NO:405, SEQ ID NO:690, SEQ ID NO:589, or SEQ ID NO:53, respectively.

For example, the alignment in FIG. 12 provides the amino acid sequences of Lead CDNA ID 23557940 (SEQ ID NO:80), CeresClone:475730 (SEQ ID NO:81) and Ceres-Clone:1534270 (SEQ ID NO:82).

The alignment in FIG. 64 provides the amino acid sequences of Lead CeresClone 35429 (SEQ ID NO:405) and CeresClone:539578 (SEQ ID NO:406).

The alignment in FIG. 104 provides the amino acid sequences of Lead CeresClone 34553 (SEQ ID NO:690), CeresClone:463380 (SEQ ID NO:691), CeresGdna:1534144 (SEQ ID NO:693), gi|34903896 (SEQ ID NO:694), Ceres-Gdna:1479838 (SEQ ID NO:696), and gi|92871553 (SEQ ID NO:697).

The alignment in FIG. 90 provides the amino acid sequences of Lead CeresClone 6568 (SEQ ID NO:589), gi|1869928 (SEQ ID NO:590) and gi|7489532 (SEQ ID NO:591).

The alignment in FIG. 8 provides the amino acid sequences of Lead CDNA ID 23522373 (SEQ ID NO:53), gi|3608135 (SEQ ID NO:54), CeresClone:1188156 (SEQ ID NO:55), and gi|42570366 (SEQ ID NO:56).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 81-82, SEQ ID NO:406, SEQ ID NO:691, SEQ ID NOs:693- 694, SEQ ID NOs:696-697, SEQ ID NOs:590-591, SEQ ID NOs:54-56, or the consensus sequence set forth in FIG. 12, FIG. 64, FIG. 104, FIG. 90, or FIG. 8.

A regulatory protein can have an mTERF domain. The human mitochondrial transcription termination factor (mTERF) polypeptide possesses three putative leucine zippers, one of which is bipartite. The mTERF polypeptide also contains two widely spaced basic domains. Both of the basic domains and the three leucine zipper motifs are necessary for DNA binding. The mTERF polypeptide binds DNA as a monomer. While evidence of intramolecular leucine zipper interactions exists, the leucine zippers are not implicated in dimerization, unlike other leucine zippers. SEQ ID NO:45, SEQ ID NO:88, SEQ ID NO:444, SEQ ID NO:554, and SEQ ID NO:613 set forth the amino acid sequences of DNA clones, identified herein as Ceres CDNA ID no. 23512013 (SEQ ID NO:44), Ceres CDNA ID no. 23653450 (SEQ ID NO:87), Ceres CLONE ID no. 386908 (SEQ ID NO:443), Ceres CLONE ID no. 553603 (SEQ ID NO:553), and Ceres CLONE ID no. 955048 (SEQ ID NO:612), respectively, each of which is predicted to encode a polypeptide having an mTERF domain.

A regulatory protein can comprise the amino acid sequence set forth in SEQ ID NO:45, SEQ ID NO:88, SEQ ID NO:444, SEQ ID NO:554, or SEQ ID NO:613. Alternatively, a regulatory protein can be a homolog, ortholog, or variant of the polypeptide having the amino acid sequence set forth in SEQ ID NO:45, SEQ ID NO:88, SEQ ID NO:444, SEQ ID NO:554, or SEQ ID NO:613. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:45, SEQ ID NO:88, SEQ ID NO:444, SEQ ID NO:554, and SEQ ID NO:613.

Amino acid sequences of homologs and/or orthologs of the polypeptide having the amino acid sequence set forth in SEQ ID NO:88, SEQ ID NO:554, and SEQ ID NO:613 are provided in FIG. 13, FIG. 85, and FIG. 94, respectively. Each of FIG. 13, FIG. 85, and FIG. 94 also includes a consensus amino acid sequence determined by aligning homologous and/or orthologous amino acid sequences with the amino acid sequence set forth in SEQ ID NO:88, SEQ ID NO:554, or SEQ ID NO:613, respectively.

For example, the alignment in FIG. 13 provides the amino acid sequences of Lead CDNA ID 23653450 (SEQ ID NO:88), CeresClone:918824 (SEQ ID NO:89) and gi|50938747 (SEQ ID NO:90).

The alignment in FIG. 85 provides the amino acid sequences of Lead CeresClone 553603 (SEQ ID NO:554) and CeresClone:720248 (SEQ ID NO:555).

The alignment in FIG. 94 provides the amino acid sequences of Lead CeresClone 955048 (SEQ ID NO:613) and gi|3128213 (SEQ ID NO:614).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 89-90, SEQ ID NO:555, SEQ ID NO:614, or the consensus sequence set forth in FIG. 13, FIG. 85, or FIG. 94.

A regulatory protein can contain a myb-like DNA binding domain characteristic of myb-like transcription factor polypeptides. The retroviral oncogene v-myb and its cellular counterpart c-myb encode nuclear DNA binding polypeptides. These polypeptides belong to the SANT domain family that specifically recognize the sequence YAAC(G/T)G. In myb, one of the most conserved regions consisting of three tandem repeats has been shown to be involved in DNA binding. *Arabidopsis thaliana* is estimated to contain more than a 140 MYB or MYB-related genes. In contrast to animals, plants contain a MB-protein subfamily that is characterized by the R2R3-type MYB domain. Classical MYB factors, which are related to c-MYB, seem to be involved in the control of the cell cycle in animals, plants and other higher eukaryotes. R2R3-type MYB genes control many aspects of plant secondary metabolism, as well as the identity and fate of plant cells. SEQ ID NO:124, SEQ ID NO:173, SEQ ID NO:291, SEQ ID NO:328, SEQ ID NO:403, SEQ ID NO:740, and SEQ ID NO:707 set forth the amino acid sequences of DNA clones, identified herein as Ceres CLONE ID no. 115924 (SEQ ID NO:123), Ceres CLONE ID no. 154718 (SEQ ID NO:172), Ceres CLONE ID no. 25795 (SEQ ID NO:290), Ceres CLONE ID no. 306497 (SEQ ID NO:327), Ceres CLONE ID no. 34589 (SEQ ID NO:402), Ceres CLONE ID no. 143475 (SEQ ID NO:739), and Ceres CLONE ID no. 40196 (SEQ ID NO:706), respectively, each of which is predicted to encode a polypeptide containing a myb-like DNA binding domain.

A regulatory protein can comprise the amino acid sequence set forth in SEQ ID NO:124, SEQ ID NO:173, SEQ ID NO:291, SEQ ID NO:328, SEQ ID NO:403, SEQ ID NO:740, or SEQ ID NO:707. Alternatively, a regulatory protein can be a homolog, ortholog, or variant of the polypeptide having the amino acid sequence set forth in SEQ ID NO:124, SEQ ID NO:173, SEQ ID NO:291, SEQ ID NO:328, SEQ ID NO:403, SEQ ID NO:740, or SEQ ID NO:707. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:124, SEQ ID NO:173, SEQ ID NO:291, SEQ ID NO:328, SEQ ID NO:403, SEQ ID NO:740, or SEQ ID NO:707.

Amino acid sequences of homologs and/or orthologs of the polypeptide having the amino acid sequence set forth in SEQ ID NO:124, SEQ ID NO:173, SEQ ID NO:291, SEQ ID NO:328, and SEQ ID NO:707 are provided in FIG. 19, FIG. 27, FIG. 42, FIG. 50, and FIG. 105, respectively. Each of FIG. 19, FIG. 27, FIG. 42, FIG. 50, and FIG. 105 also includes a consensus amino acid sequence determined by aligning homologous and/or orthologous amino acid sequences with the amino acid sequence set forth in SEQ ID NO:124, SEQ ID NO:173, SEQ ID NO:291, SEQ ID NO:328, or SEQ ID NO:707, respectively.

For example, the alignment in FIG. 19 provides the amino acid sequences of Lead CeresClone 115924 (SEQ ID NO:124), CeresClone:477003 (SEQ ID NO:125), CeresClone:894637 (SEQ ID NO:126), and gi|50725048 (SEQ ID NO:127).

The alignment in FIG. 27 provides the amino acid sequences of Lead CeresClone 154718 (SEQ ID NO:173) with homologous and/or orthologous amino acid sequences gi|2832408 (SEQ ID NO:174) and gi|50872446 (SEQ ID NO:175).

The alignment in FIG. 42 provides the amino acid sequences of Lead CeresClone 25795 (SEQ ID NO:291) and CeresClone:1104601 (SEQ ID NO:292).

The alignment in FIG. 50 provides the amino acid sequences of Lead CeresClone 306497 (SEQ ID NO:328) and gi|50944571 (SEQ ID NO:329).

The alignment in FIG. 105 provides the amino acid sequences of Lead CeresClone 40196 (SEQ ID NO:707) and CeresClone:467905 (SEQ ID NO:708).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 125-127, SEQ ID NOs:174-175, SEQ ID NO:292, SEQ ID NO:329*, SEQ ID NO:708, or the consensus sequence set forth in FIG. 19, FIG. 27, FIG. 42, FIG. 50, or FIG. 105.

A regulatory protein can contain a B3 DNA binding domain characteristic of a family of plant transcription factors with various roles in development. A B3 DNA binding domain is found in VP1/AB13 transcription factors. Some proteins, such as RAV1, also have an AP2 DNA binding domain. SEQ ID NO:397, SEQ ID NO:412, and SEQ ID NO:593 set forth the amino acid sequences of DNA clones, identified herein as Ceres CLONE ID no. 34183 (SEQ ID NO:396), Ceres CLONE ID no. 362309 (SEQ ID NO:411), and Ceres CLONE ID no. 660003 (SEQ ID NO:592), respectively, each of which is predicted to encode a polypeptide containing a B3 DNA binding domain. SEQ ID NO:436 sets forth the amino acid sequence of a DNA clone, identified herein as Ceres CLONE ID no. 38311 (SEQ ID NO:435), that is predicted to encode a polypeptide having an AP2 and a B3 DNA binding domain.

A regulatory protein can comprise the amino acid sequence set forth in SEQ ID NO:397, SEQ ID NO:412, SEQ ID NO:593, or SEQ ID NO:436. Alternatively, a regulatory protein can be a homolog, ortholog, or variant of the polypeptide having the amino acid sequence set forth in SEQ ID NO:397, SEQ ID NO:412, SEQ ID NO:593, or SEQ ID NO:436. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:397, SEQ ID NO:412, SEQ ID NO:593, or SEQ ID NO:436.

Amino acid sequences of homologs and/or orthologs of the polypeptide having the amino acid sequence set forth in SEQ ID NO:412 and SEQ ID NO:436 are provided in FIG. 66 and FIG. 71, respectively. Each of FIG. 66 and FIG. 71 also includes a consensus amino acid sequence determined by aligning homologous and/or orthologous amino acid sequences with the amino acid sequence set forth in SEQ ID NO:412 or SEQ ID NO:436, respectively.

For example, the alignment in FIG. 66 provides the amino acid sequences of Lead CeresClone 362309 (SEQ ID NO:412), CeresClone:887276 (SEQ ID NO:413) and gi|51091016 (SEQ ID NO:414).

The alignment in FIG. 71 provides the amino acid sequences of Lead CeresClone 38311 (SEQ ID NO:436), CeresClone:19561 (SEQ ID NO:437), CeresClone:597624 (SEQ ID NO:438), gi|33320073 (SEQ ID NO:439), CeresClone:705041 (SEQ ID NO:440), CeresClone:331400 (SEQ ID NO:441), and gi|50932645 (SEQ ID NO:442).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 413-414, SEQ ID NOs:437-442, or the consensus sequence set forth in FIG. 66, or FIG. 71.

A regulatory protein can contain an SRF-TF domain characteristic of an SRF-type transcription factor (DNA binding and dimerization domain) polypeptide. Human serum response factor (SRF) is a ubiquitous nuclear polypeptide important for cell proliferation and differentiation. SRF function is essential for transcriptional regulation of numerous growth-factor-inducible genes, such as the c-fos oncogene and muscle-specific actin genes. A core domain of about 90 amino acids is sufficient for the activities of DNA binding, dimerization, and interaction with accessory factors. Within the core is a DNA binding region, designated the MADS box, that is highly similar to many eukaryotic regulatory proteins, including the Agamous and Deficiens families of plant homeotic polypeptides. SEQ ID NO:19 and SEQ ID NO:855 set forth the amino acid sequences of DNA clones, identified herein as Ceres CDNA ID no. 23495742 (SEQ ID NO:18) and Ceres CDNA no. 12729193 (SEQ ID NO:854), respectively, each of which is predicted to encode an SRF-type transcription factor (DNA binding and dimerization domain) polypeptide.

In some cases, a regulatory protein can contain an SRF-TF domain and a K-box region. Moreover, a K-box region is commonly found associated with SRF-type transcription factors. The K-box is predicted to have a coiled-coil structure and play a role in multimer formation. SEQ ID NO:253, SEQ ID NO:287, and SEQ ID NO:349 set forth the amino acid sequences of DNA clones, identified herein as Ceres CLONE ID no. 22339 (SEQ ID NO:252), Ceres CLONE ID no. 241491 (SEQ ID NO:286), and Ceres CLONE ID no. 331626 (SEQ ID NO:348), respectively, each of which is predicted to encode an SRF-type transcription factor polypeptide having a K-box region.

A regulatory protein can comprise the amino acid sequence set forth in SEQ ID NO:19, SEQ ID NO:855, SEQ ID NO:253, SEQ ID NO:287, or SEQ ID NO:349. Alternatively, a regulatory protein can be a homolog, ortholog, or variant of the polypeptide having the amino acid sequence set forth in SEQ ID NO:19, SEQ ID NO:855, SEQ ID NO:253, SEQ ID NO:287, or SEQ ID NO:349. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:19, SEQ ID NO:855, SEQ ID NO:253, SEQ ID NO:287, or SEQ ID NO:349.

Amino acid sequences of homologs and/or orthologs of the polypeptide having the amino acid sequence set forth in SEQ ID NO:19, SEQ ID NO:253, and SEQ ID NO:349 are provided in FIG. 3, FIG. 38, and FIG. 54, respectively. Each of FIG. 3, FIG. 38, and FIG. 54 also includes a consensus amino acid sequence determined by aligning homologous and/or orthologous amino acid sequences with the amino acid sequence set forth in SEQ ID NO:19, SEQ ID NO:253, or SEQ ID NO:349, respectively.

For example, the alignment in FIG. 3 provides the amino acid sequences of Lead CDNA ID 23495742 (SEQ ID NO:19) and CeresClone:681294 (SEQ ID NO:20).

The alignment in FIG. 38 provides the amino acid sequences of Lead CeresClone 22339 (SEQ ID NO:253), gi|52548134 (SEQ ID NO:254), gi|52548152 (SEQ ID NO:255), CeresClone:103400 (SEQ ID NO:256), gi|17223670 (SEQ ID NO:257), gi|16973296 (SEQ ID NO:258), gi|33308109 (SEQ ID NO:259), CeresClone: 1043518 (SEQ ID NO:260), CeresClone:1046745 (SEQ ID NO:261), gi|62132641 (SEQ ID NO:262), gi|14279306 (SEQ ID NO:263), and gi|52548104 (SEQ ID NO:264).

The alignment in FIG. 54 provides the amino acid sequences of Lead CeresClone 331626 (SEQ ID NO:349), gi|24967140 (SEQ ID NO:350), gi|21586457 (SEQ ID NO:351), gi|50940449 (SEQ ID NO:352), and gi|16549066 (SEQ ID NO:353).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NO:20, SEQ ID NOs:254-264, SEQ ID NOs:350-353, or the consensus sequence set forth in FIG. 3, FIG. 38, or FIG. 54.

A regulatory protein can have a TCP domain characteristic of a TCP family transcription factor polypeptide. Members of the TCP family contain conserved regions that are predicted to form a non-canonical basic-helix-loop-helix (bHLH) structure. In rice, this domain was shown to be involved in DNA binding and dimerization. In *Arabidopsis*, members of the TCP family were expressed in rapidly growing floral primordia. It is likely that members of the TCP family affect cell division. SEQ ID NO:768 and SEQ ID NO:822 set forth the amino acid sequences of DNA clones, identified herein as Ceres CLONE no. 248061 (SEQ ID NO:767) and Ceres CLONE no. 546496 (SEQ ID NO:821), respectively, each of which is predicted to encode a TCP family transcription factor polypeptide.

A regulatory protein can comprise the amino acid sequence set forth in SEQ ID NO:768 or SEQ ID NO:822. Alternatively, a regulatory protein can be a homolog, ortholog, or variant of the polypeptide having the amino acid sequence set forth in SEQ ID NO:768 or SEQ ID NO:822. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:768 or SEQ ID NO:822.

A regulatory protein can contain a CBFD_NFYB_HMF domain found in the histone-like transcription factor (CBF/NF-Y) and archaeal histones. The CCAAT-binding factor (CBF) is a mammalian transcription factor that binds to a CCAAT motif in the promoters of a wide variety of genes, including type I collagen and albumin. CBF is a heteromeric complex of A and B subunits, both of which are required for DNA-binding. The subunits can interact in the absence of DNA-binding, with conserved regions in each subunit being important in mediating this interaction. The A subunit can be divided into three domains on the basis of sequence similarity: a non-conserved N-terminal A domain; a highly-conserved central B domain involved in DNA-binding; and a C-terminal C domain, which contains a number of glutamine and acidic residues involved in polypeptide-polypeptide interactions. SEQ ID NO:604 and SEQ ID NO:834 set forth the amino acid sequences of DNA clones, identified herein as Ceres CLONE ID no. 7805 (SEQ ID NO:603) and Ceres CLONE no. 982774 (SEQ ID NO:833), respectively, each of which is predicted to encode a polypeptide containing a CBFD_NFYB_HMF domain.

A regulatory protein can comprise the amino acid sequence set forth in SEQ ID NO:604 or SEQ ID NO:834. Alternatively, a regulatory protein can be a homolog, ortholog, or variant of the polypeptide having the amino acid sequence set forth in SEQ ID NO:604 or SEQ ID NO:834. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:604 or SEQ ID NO:834.

Amino acid sequences of homologs and/or orthologs of the polypeptide having the amino acid sequence set forth in SEQ ID NO:604 are provided in FIG. 92. FIG. 92 also includes a consensus amino acid sequence determined by aligning homologous and/or orthologous amino acid sequences with the amino acid sequence set forth in SEQ ID NO:604.

For example, the alignment in FIG. 92 provides the amino acid sequences of Lead CeresClone 7805 (SEQ ID NO:604) and CeresClone:1045975 (SEQ ID NO:605).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to SEQ ID NO:605 or the consensus sequence set forth in FIG. 92.

A regulatory protein can contain a Histone domain characteristic of a core histone H2A/H2B/H3/H4 polypeptide. The core histones, together with other DNA binding proteins, form a superfamily defined by a common fold and distant sequence similarities. Some proteins contain local homology domains related to the histone fold. SEQ ID NO:416 sets forth the amino acid sequence of a DNA clone, identified herein as Ceres CLONE ID no. 36272 (SEQ ID NO:415), that is predicted to encode a polypeptide containing a Histone domain.

A regulatory protein can comprise the amino acid sequence set forth in SEQ ID NO:416. Alternatively, a regulatory protein can be a homolog, ortholog, or variant of the polypeptide having the amino acid sequence set forth in SEQ ID NO:416. For example, a regulatory protein can have an amino acid sequence with at least 60% sequence identity, e.g., 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:416.

Amino acid sequences of homologs and/or orthologs of the polypeptide having the amino acid sequence set forth in SEQ ID NO:416 are provided in FIG. 67. FIG. 67 also includes a consensus amino acid sequence determined by aligning homologous and/or orthologous amino acid sequences with the amino acid sequence set forth in SEQ ID NO:416.

For example, the alignment in FIG. 67 provides the amino acid sequences of Lead CeresClone 36272 (SEQ ID NO:416), CeresClone:1911 (SEQ ID NO:417), gi|23505813 (SEQ ID NO:418), gi|6289057 (SEQ ID NO:419), gi|1922964 (SEQ ID NO:420), CeresClone:573215 (SEQ ID NO:421), and CeresClone:474481 (SEQ ID NO:422).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 417-422 or the consensus sequence set forth in FIG. 67.

A regulatory protein can contain one or more domains characteristic of a transcription initiation factor polypeptide. For example, a regulatory protein can contain a TFIIA domain characteristic of the precursor polypeptide that yields both the alpha and beta subunits of the transcription initiation factor IIA (TFIIA) polypeptide. TFIIA is a heterotrimer composed of alpha, beta, and gamma subunits. The TFIIA heterotrimer is a general transcription initiation factor for genes transcribed by RNA polymerase II. Together with TFIID, TFIIA binds to the promoter region. This is the first step in the formation of a pre-initiation complex, which is followed by binding of the rest of the transcription machinery. SEQ ID NO:249 sets forth the amino acid sequence of a DNA clone, identified herein as Ceres CLONE ID no. 222894 (SEQ ID NO:248), that is predicted to encode a polypeptide containing a TFIIA domain.

In some cases, a regulatory protein can have a TFIIA_gamma_N domain and a TFIIA_gamma_C domain characteristic of the N-terminal and the C-terminal domain, respectively, of the gamma subunit of TFIIA. The N-terminal domain of the gamma subunit is a four helix bundle, while the C-terminal domain is a twelve stranded beta-barrel. SEQ ID NO:266 sets forth the amino acid sequence of a DNA clone, identified herein as Ceres CLONE ID no. 225321 (SEQ ID NO:265), that is predicted to encode a polypeptide containing a TFIIA_gamma_N domain and a TFIIA_gamma_C domain.

In some cases, a regulatory protein can contain a TFIID_30 kDa domain characteristic of the transcription initiation factor TFIID 23-30 kDa subunit. Transcription initiation factor TFIID is a multimeric protein complex that plays a central role in mediating promoter responses to various activators and repressors. TFIID acts to nucleate the transcription complex, recruiting the rest of the factors through a direct interaction with TFIIB. The TATA binding protein subunit of TFIID is sufficient for TATA-element binding and TFIIB interaction, and can support basal transcription. SEQ ID NO:222 sets forth the amino acid sequence of a DNA clone, identified herein as Ceres CLONE ID no. 208303 (SEQ ID NO:221), that is predicted to encode a polypeptide containing a TFIID_30 kDa domain.

A regulatory protein can comprise the amino acid sequence set forth in SEQ ID NO:249, SEQ ID NO:266, or SEQ ID NO:222. Alternatively, a regulatory protein can be a homolog, ortholog, or variant of the polypeptide having the amino acid sequence set forth in SEQ ID NO:249, SEQ ID NO:266, or SEQ ID NO:222. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:249, SEQ ID NO:266, or SEQ ID NO:222.

Figure 39:
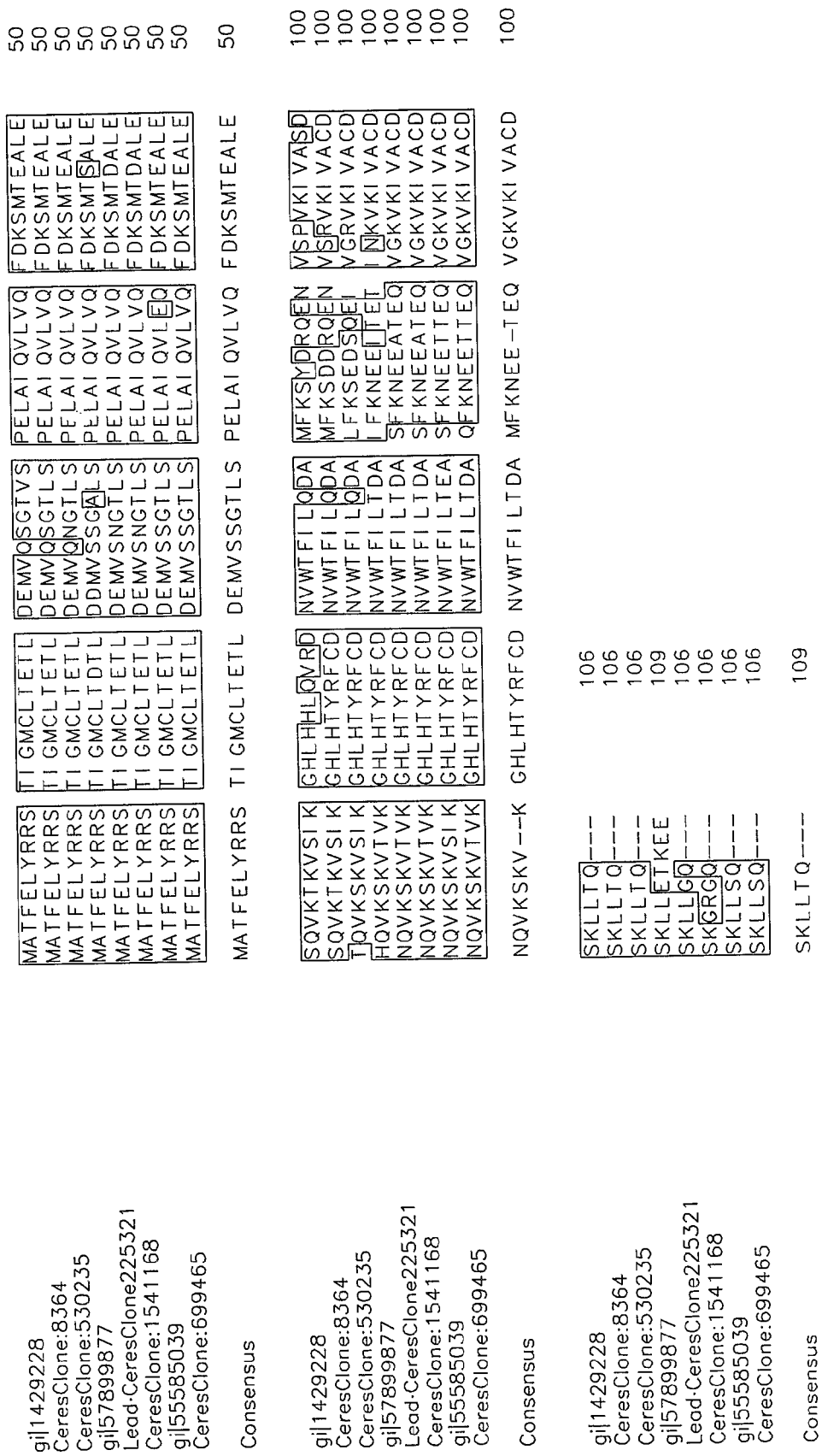
FIG. 39 is an alignment of the amino acid sequence of Lead CeresClone 225321 (SEQ ID NO:266) with homologous and/or orthologous amino acid sequences CeresClone:1541168 (SEQ ID NO:267), CeresClone:699465 (SEQ ID NO:268), gi|55585039 (SEQ ID NO:269), gi|57899877 (SEQ ID NO:270), CeresClone:530235 (SEQ ID NO:271), CeresClone:8364 (SEQ ID NO:272), and gi|1429228 (SEQ ID NO:273). The consensus sequence determined by the alignment is set forth.

Amino acid sequences of homologs and/or orthologs of the polypeptide having the amino acid sequence set forth in SEQ ID NO:249, SEQ ID NO:266, and SEQ ID NO:222 are provided in FIG. 37, FIG. 39, and FIG. 34, respectively. Each of FIG. 37, FIG. 39, and FIG. 34 also includes a consensus amino acid sequence determined by aligning homologous and/or orthologous amino acid sequences with the amino acid sequence set forth in SEQ ID NO:249, SEQ ID NO:266, or SEQ ID NO:222, respectively.

For example, the alignment in FIG. 37 provides the amino acid sequences of Lead CeresClone 222894 (SEQ ID NO:249), gi|39545932 (SEQ ID NO:250) and CeresClone: 1168684 (SEQ ID NO:251).

The alignment in FIG. 39 provides the amino acid sequences of Lead CeresClone 225321 (SEQ ID NO:266), CeresClone:1541168 (SEQ ID NO:267), CeresClone: 699465 (SEQ ID NO:268), gi|55585039 (SEQ ID NO:269), gi|57899877 (SEQ ID NO:270), CeresClone:530235 (SEQ ID NO:271), CeresClone:8364 (SEQ ID NO:272), and gi|1429228 (SEQ ID NO:273).

The alignment in FIG. 34 provides the amino acid sequences of Lead CeresClone 208303 (SEQ ID NO:222), CeresClone:25793 (SEQ ID NO:223), CeresClone:1100893 (SEQ ID NO:224), gi|41529318 (SEQ ID NO:225), CeresClone:1052135 (SEQ ID NO:226), and gi|50726325 (SEQ ID NO:227).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 250-251, SEQ ID NOs:267-273, SEQ ID NOs:223-227, or the consensus sequence set forth in FIG. 37, FIG. 39, or FIG. 34.

A regulatory protein can contain a transcription factor TFIIB repeat. The TFIIB repeat is a cyclin related domain associated with TFIIB. TFIIB is a general transcription factor and one of the mediators linking the TATA-binding proteins TBP and RNA polymerase II. SEQ ID NO:446 sets forth the amino acid sequence of a DNA clone, identified herein as Ceres CLONE ID no. 38950 (SEQ ID NO:445), that is predicted to encode a polypeptide containing a TFIIB repeat.

A regulatory protein can comprise the amino acid sequence set forth in SEQ ID NO:446. Alternatively, a regulatory protein can be a homolog, ortholog, or variant of the polypeptide having the amino acid sequence set forth in SEQ ID NO:446. For example, a regulatory protein can have an amino acid sequence with at least 45% sequence identity, e.g., 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:446.

Amino acid sequences of homologs and/or orthologs of the polypeptide having the amino acid sequence set forth in SEQ ID NO:446 are provided in FIG. 72. FIG. 72 also includes a consensus amino acid sequence determined by aligning homologous and/or orthologous amino acid sequences with the amino acid sequence set forth in SEQ ID NO:446.

For example, the alignment in FIG. 72 provides the amino acid sequences of Lead CeresClone 38950 (SEQ ID NO:446) with homologous and/or orthologous amino acid sequences CeresClone:2657 (SEQ ID NO:447), gi|18481632 (SEQ ID NO:448), and CeresClone:749427 (SEQ ID NO:449).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 447-449 or the consensus sequence set forth in FIG. 72.

A regulatory protein can have one or more domains characteristic of a transcription elongation factor. For example, a regulatory protein can have a TFIIS_M domain and a TFIIS_C domain. The TFIIS_M and TFIIS_C domains are found in the central region and C-terminus, respectively, of transcription elongation factor S-II (TFIIS). TFIIS is a general elongation factor that regulates transcription elongation by RNA polymerase II and stimulates RNA polymerase II to transcribe through regions of DNA that promote the formation of stalled ternary complexes. TFIIS induces mRNA cleavage by enhancing the intrinsic nuclease activity of RNA polymerase II. TFIIS comprises an N-terminal domain I, a central domain II (TFIIS_M), and a C-terminal domain III (TFIIS_C). The TFIIS_M and TFIIS_C domains are required for transcription activity. TFIIS_C, which is able to bind zinc and has a β-sheet secondary structure, has also been described as the zinc ribbon C-terminal domain. TFIIS_M contains only α-helical secondary structural elements. SEQ ID NO:4 sets forth the amino acid sequence of a DNA clone, identified herein as Ceres CDNA ID no. 23381275 (SEQ ID NO:3), that is predicted to encode a polypeptide containing a TFIIS_M domain and a TFIIS_C domain.

In some cases, a regulatory protein having a TFIIS_C domain can also have a RNA_POL_M_15 KD domain characteristic of highly conserved small subunits of about 15 kDa found in RNA polymerase types I and II. These polypeptides contain a probable zinc finger in the N-terminus and a zinc ribbon in the C-terminus. SEQ ID NO:666 sets forth the amino acid sequence of a DNA clone, identified herein as Ceres CLONE no. 16473 (SEQ ID NO:665), that is predicted to encode a polypeptide containing a TFIIS_C domain and an RNA_POL_M_15 KD domain.

A regulatory protein can comprise the amino acid sequence set forth in SEQ ID NO:4 or SEQ ID NO:666. Alternatively, a regulatory protein can be a homolog, ortholog, or variant of the polypeptide having the amino acid sequence set forth in SEQ ID NO:4 or SEQ ID NO:666. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:4 or SEQ ID NO:666.

Amino acid sequences of homologs and/or orthologs of the polypeptide having the amino acid sequence set forth in SEQ ID NO:666 are provided in FIG. 102. FIG. 102 also includes a consensus amino acid sequence determined by aligning homologous and/or orthologous amino acid sequences with the amino acid sequence set forth in SEQ ID NO:666.

For example, the alignment in FIG. 102 provides the amino acid sequences of Lead CeresClone 16473 (SEQ ID NO:666), CeresClone:9720 (SEQ ID NO:667), CeresClone:1088401 (SEQ ID NO:668), CeresClone:1121766 (SEQ ID NO:669), CeresGdna:1467514 (SEQ ID NO:671), and gi|50251233 (SEQ ID NO:672).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 667-669, SEQ ID NOs:671-672 or the consensus sequence set forth in FIG. 102.

A regulatory protein can have an RNA_pol_Rpb7_N domain characteristic of the N-terminal domain of an RNA polymerase Rpb7-like polypeptide. The eukaryotic RNA polymerase subunits Rpb4 and Rpb7 form a heterodimer that reversibly associates with the RNA polymerase II core and is thought to interact with the nascent RNA strand during RNA polymerase II elongation. SEQ ID NO:663 sets forth the amino acid sequence of a DNA clone, identified herein as Ceres CLONE no. 16450 (SEQ ID NO:662), that is predicted to encode a polypeptide containing an RNA_pol_Rpb7_N domain.

A regulatory protein can comprise the amino acid sequence set forth in SEQ ID NO:663. Alternatively, a regulatory protein can be a homolog, ortholog, or variant of the polypeptide having the amino acid sequence set forth in SEQ ID NO:663. For example, a regulatory protein can have an amino acid sequence with at least 45% sequence identity, e.g., 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:663.

Amino acid sequences of homologs and/or orthologs of the polypeptide having the amino acid sequence set forth in SEQ ID NO:663 are provided in FIG. 101. FIG. 101 also includes a consensus amino acid sequence determined by aligning homologous and/or orthologous amino acid sequences with the amino acid sequence set forth in SEQ ID NO:663.

For example, the alignment in FIG. 101 provides the amino acid sequences of Lead CeresClone 16450 (SEQ ID NO:663) and CeresClone:974460 (SEQ ID NO:664).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to SEQ ID NO:664 or the consensus sequence set forth in FIG. 101.

A regulatory protein can have a paired amphipathic helix (PAH) repeat. The PAH repeat may be distantly related to the helix-loop-helix motif, which mediates polypeptide-polypeptide interactions. Members of the PAH repeat family of polypeptides include the eukaryotic Sin3 polypeptides, which have at least three PAH domains (PAH1, PAH2, and PAH3). Sin3 polypeptides are components of a co-repressor complex that silences transcription, playing important roles in the transition between proliferation and differentiation. SEQ ID NO:66 and SEQ ID NO:289 set forth the amino acid sequences of DNA clones, identified herein as Ceres CDNA ID no. 23530574 (SEQ ID NO:65) and Ceres CLONE ID no. 250028 (SEQ ID NO:288), respectively, each of which is predicted to encode a polypeptide containing a PAH repeat.

A regulatory protein can comprise the amino acid sequence set forth in SEQ ID NO:66 or SEQ ID NO:289. Alternatively, a regulatory protein can be a homolog, ortholog, or variant of the polypeptide having the amino acid sequence set forth in SEQ ID NO:66 or SEQ ID NO:289. For example, a regulatory protein can have an amino acid sequence with at least 40% sequence identity, e.g., 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:66 or SEQ ID NO:289.

Amino acid sequences of homologs and/or orthologs of the polypeptide having the amino acid sequence set forth in SEQ ID NO:66 are provided in FIG. 10. FIG. 10 also includes a consensus amino acid sequence determined by aligning homologous and/or orthologous amino acid sequences with the amino acid sequence set forth in SEQ ID NO:66.

For example, the alignment in FIG. 10 provides the amino acid sequences of Lead CDNA ID 23530574 (SEQ ID NO:66) with homologous and/or orthologous amino acid sequence gi|7486367 (SEQ ID NO:67).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to SEQ ID NO:67 or the consensus sequence set forth in FIG. 10.

A regulatory protein can contain a KNOX1 domain, a KNOX2 domain, and an ELK domain. Knotted1-like homeobox (knox) genes encoding KNOX proteins have been isolated from various plants, including rice, barley, *Arabidopsis*, soybean, tomato, and tobacco. There are four putative functional domains that are conserved in plant KNOX proteins: the MEINOX domain, which can divided into two subdomains, KNOX1 and KNOX2; the GSE domain; the ELK domain; and the homeodomain. KNOX1 plays a role in suppressing target gene expression, and KNOX2 is thought to be necessary for homo-dimerization. The ELK domain has been postulated to be involved in nuclear localization, protein-protein interactions, and suppression of gene activation. SEQ ID NO:245 and SEQ ID NO:374 set forth the amino acid sequences of DNA clones, identified herein as Ceres CLONE ID no. 21240 (SEQ ID NO:244) and Ceres CLONE ID no. 336323 (SEQ ID NO:373), respectively, each of which is predicted to encode a polypeptide containing a KNOX1 domain, a KNOX2 domain, and an ELK domain.

A regulatory protein can comprise the amino acid sequence set forth in SEQ ID NO:245 or SEQ ID NO:374. Alternatively, a regulatory protein can be a homolog, ortholog, or variant of the polypeptide having the amino acid sequence set forth in SEQ ID NO:245 or SEQ ID NO:374. For example, a regulatory protein can have an amino acid sequence with at least 75% sequence identity, e.g., 76%, 80%, 85%, 90%, 95%, 97%, 98%, or 99% sequence identity, to the amino acid sequence set forth in SEQ ID NO:245 or SEQ ID NO:374.

Figure 36:
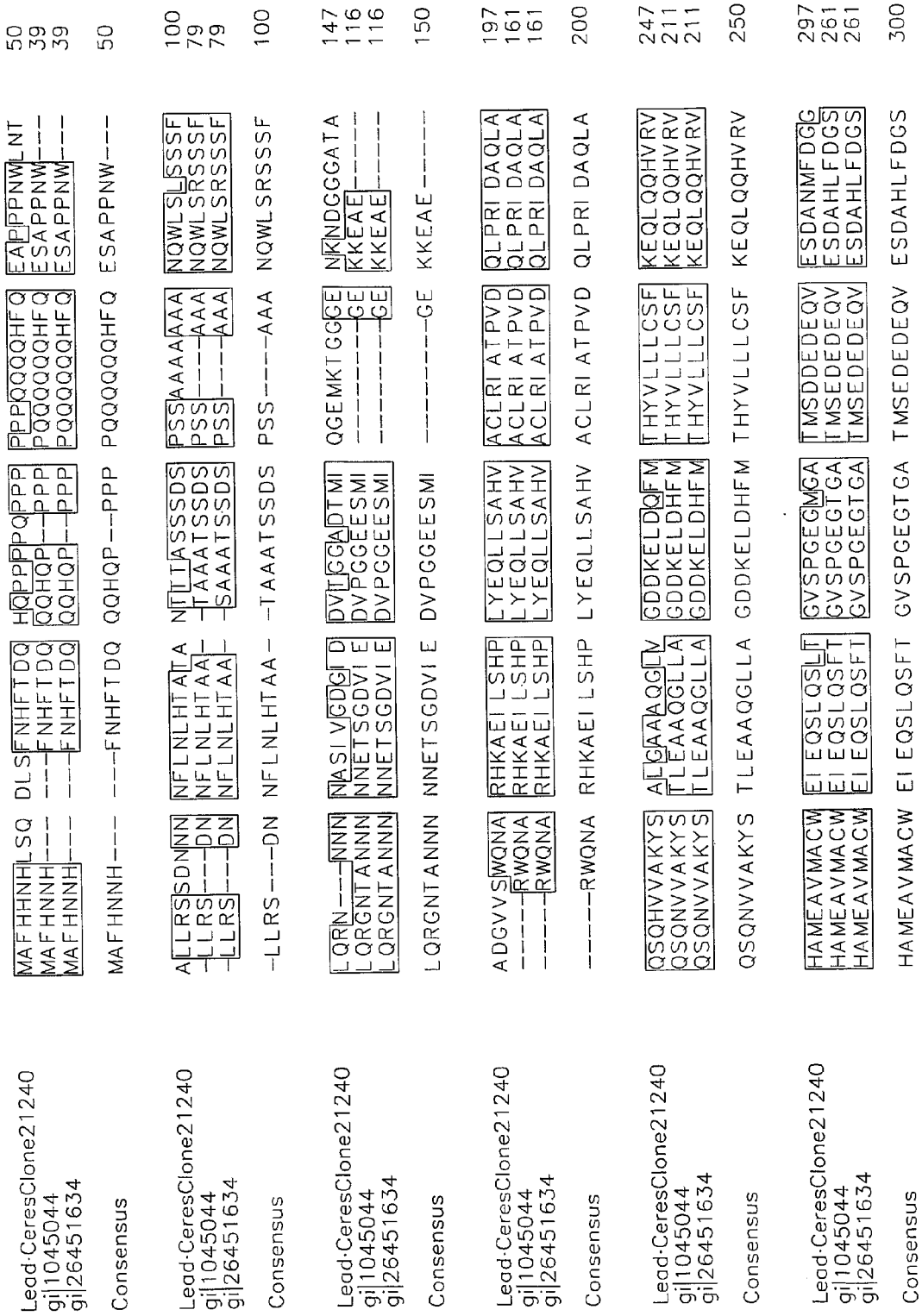
FIG. 36 is an alignment of the amino acid sequence of Lead CeresClone 21240 (SEQ ID NO:245) with homologous and/or orthologous amino acid sequences gi|1045044 (SEQ ID NO:246) and gi|26451634 (SEQ ID NO:247). The consensus sequence determined by the alignment is set forth.

Amino acid sequences of homologs and/or orthologs of the polypeptide having the amino acid sequence set forth in SEQ ID NO:245 and SEQ ID NO:374 are provided in FIG. 36 and FIG. 59, respectively. Each of FIG. 36 and FIG. 59 also includes a consensus amino acid sequence determined by aligning homologous and/or orthologous amino acid sequences with the amino acid sequence set forth in SEQ ID NO:245 or SEQ ID NO:375, respectively.

For example, the alignment in FIG. 36 provides the amino acid sequences of Lead CeresClone 21240 (SEQ ID NO:245), gi|1045044 (SEQ ID NO:246) and gi|26451634 (SEQ ID NO:247).

The alignment in FIG. 59 provides the amino acid sequences of Lead CeresClone 336323 (SEQ ID NO:374), CeresClone:106887 (SEQ ID NO:375), gi|21618231 (SEQ ID NO:376), gi|8493589 (SEQ ID NO:377), CeresClone: 1076901 (SEQ ID NO:378), gi|453949 (SEQ ID NO:379), CeresClone:52899 (SEQ ID NO:380), CeresClone:298091 (SEQ ID NO:381), and gi|14149141 (SEQ ID NO:382).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 246-247, SEQ ID NOs:375-382, or the consensus sequence set forth in FIG. 36 or FIG. 59.

A regulatory protein can contain an AUX_IAA domain. The Aux/IAA family of genes are key regulators of auxin-modified gene expression. The plant hormone auxin (indole-3-acetic acid, IAA) regulates diverse cellular and developmental responses in plants. The Aux/IAA proteins act as repressors of auxin-induced gene expression, possibly by modulating the activity of DNA binding auxin response factors (ARFs). Aux/IAA and ARF are thought to interact through C-terminal polypeptide-polypeptide interaction domains found in both Aux/IAA and ARF. Aux/IAA proteins have also been reported to mediate light responses. Some members of the AUX/IAA family are longer, contain an N-terminal DNA binding domain, and may have an early function in the establishment of vascular and body patterns during embryonic and post-embryonic development in some plants. SEQ ID NO:344 and SEQ ID NO:557 set forth the amino acid sequences of DNA clones, identified herein as Ceres CLONE ID no. 325565 (SEQ ID NO:343) and Ceres CLONE ID no. 556734 (SEQ ID NO:556), each of which is predicted to encode a polypeptide containing an AUX_IAA domain.

A regulatory protein can comprise the amino acid sequence set forth in SEQ ID NO:344 or SEQ ID NO:557. Alternatively, a regulatory protein can be a homolog, ortholog, or variant of the polypeptide having the amino acid sequence set forth in SEQ ID NO:344 or SEQ ID NO:557. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:344 or SEQ ID NO:557.

Amino acid sequences of homologs and/or orthologs of the polypeptide having the amino acid sequence set forth in SEQ ID NO:344 and SEQ ID NO:557 are provided in FIG. 53 and FIG. 86, respectively. Each of FIG. 53 and FIG. 86 also includes a consensus amino acid sequence determined by aligning homologous and/or orthologous amino acid sequences with the amino acid sequence set forth in SEQ ID NO:344 or SEQ ID NO:557, respectively.

For example, the alignment in FIG. 53 provides the amino acid sequences of Lead CeresClone 325565 (SEQ ID NO:344), gi|50934701 (SEQ ID NO:345), gi|20269063 (SEQ ID NO:346), and gi|7442240 (SEQ ID NO:347).

The alignment in FIG. 86 provides the amino acid sequences of Lead CeresClone 556734 (SEQ ID NO:557), gi|5139697 (SEQ ID NO:558), CeresClone:520455 (SEQ ID NO:559), CeresClone:574451 (SEQ ID NO:560), gi|114734 (SEQ ID NO:561), CeresClone:1113630 (SEQ ID NO:562), CeresClone:1069818 (SEQ ID NO:563), and gi|50917147 (SEQ ID NO:564).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 345-347, SEQ ID NOs:558-564, or the consensus sequence set forth in FIG. 53 or FIG. 86.

A regulatory protein can contain an HSF_DNA-bind domain characteristic of a heat shock factor (HSF)-type DNA-binding polypeptide. HSF is a transcriptional activator of heat shock genes that binds specifically to heat shock promoter elements. Under normal conditions, HSF is a homotrimeric cytoplasmic polypeptide. Heat shock activation results in relocalization of HSF to the nucleus. Each HSF monomer contains one C-terminal and three N-terminal leucine zipper repeats. Two sequences flanking the N-terminal zippers fit the consensus of a bi-partite nuclear localization signal (NLS). The DNA-binding component of HSF lies towards the N-terminus of the first NLS region, and is referred to as the HSF domain. SEQ ID NO:616 sets forth the amino acid sequence of a DNA clone, identified herein as Ceres CLONE ID no. 9552 (SEQ ID NO:615), that is predicted to encode a polypeptide containing an HSF_DNA-bind domain.

A regulatory protein can comprise the amino acid sequence set forth in SEQ ID NO:616. Alternatively, a regulatory protein can be a homolog, ortholog, or variant of the polypeptide having the amino acid sequence set forth in SEQ ID NO:616. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:616.

A regulatory protein can have one or more domains characteristic of a homeobox polypeptide. For example, a regulatory protein can contain a homeobox domain, a HALZ domain, and a HD-ZIP_N domain. Hox genes encode homeodomain-containing transcriptional regulators that operate differential genetic programs along the anterior-posterior axis of animal bodies. The homeobox domain binds DNA through a helix-turn-helix (HTH) structure. The HTH motif is characterized by two alpha-helices, which make intimate contacts with the DNA and are joined by a short turn. The homeobox associated leucine zipper (HALZ) domain is a plant specific leucine zipper that is always found associated with a homeobox. The HD-ZIP_N domain is the N-terminus of plant homeobox-leucine zipper proteins. Homeodomain leucine zipper (HDZip) genes encode putative transcription factors that are unique to plants. SEQ ID NO:710 sets forth the amino acid sequence of a DNA clone, identified herein as Ceres CLONE no. 42533 (SEQ ID NO:709), that is predicted to encode a polypeptide having a homeobox domain, a HALZ domain, and an HD-ZIP_N domain.

In some cases, a regulatory protein can have a homeobox domain and a HALZ domain. SEQ ID NO:726 sets forth the amino acid sequence of a DNA clone, identified herein as Ceres CLONE no. 101603 (SEQ ID NO:725), that is predicted to encode a polypeptide having a homeobox domain and a HALZ domain.

A regulatory protein can comprise the amino acid sequence set forth in SEQ ID NO:710 or SEQ ID NO:726. Alternatively, a regulatory protein can be a homolog, ortholog, or variant of the polypeptide having the amino acid sequence set forth in SEQ ID NO:710 or SEQ ID NO:726. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:710 or SEQ ID NO:726.

A regulatory protein can have a NAM domain characteristic of a No apical meristem (NAM) polypeptide. No apical meristem (NAM) polypeptides are plant development polypeptides. NAM is indicated as having a role in determining positions of meristems and primordia. The NAC domain (NAM for Petunia hybrida and ATAF1, ATAF2, and CUC2 for Arabidopsis) is an N-terminal module of about 160 amino acids, which is found in proteins of the NAC family of plant-specific transcriptional regulators (no apical meristem polypeptides). NAC proteins are involved in developmental processes, including formation of the shoot apical meristem, floral organs and lateral shoots, as well as in plant hormonal control and defense. The NAC domain is accompanied by diverse C-terminal transcriptional activation domains. The NAC domain has been shown to be a DNA-binding domain (DBD) and a dimerization domain. SEQ ID NO:104, SEQ ID NO:432, SEQ ID NO:540, SEQ ID NO:705, and SEQ ID NO:724 set forth the amino acid sequences of DNA clones, identified herein as Ceres CLONE ID no. 100085 (SEQ ID NO:103), Ceres CLONE ID no. 37792 (SEQ ID NO:431), Ceres CLONE ID no. 481915 (SEQ ID NO:539), Ceres CLONE no. 38858 (SEQ ID NO:704), and Ceres CLONE no. 97474 (SEQ ID NO:723), respectively, each of which is predicted to encode a polypeptide containing a NAM domain.

A regulatory protein can comprise the amino acid sequence set forth in SEQ ID NO:104, SEQ ID NO:432, SEQ ID NO:540, SEQ ID NO:705, or SEQ ID NO:724. Alternatively, a regulatory protein can be a homolog, ortholog, or variant of the polypeptide having the amino acid sequence set forth in SEQ ID NO:104, SEQ ID NO:432, SEQ ID NO:540, SEQ ID NO:705, or SEQ ID NO:724. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:104, SEQ ID NO:432, SEQ ID NO:540, SEQ ID NO:705, or SEQ ID NO:724.

Amino acid sequences of homologs and/or orthologs of the polypeptide having the amino acid sequence set forth in SEQ ID NO:432 and SEQ ID NO:540 are provided in FIG. 70 and FIG. 83, respectively. Each of FIG. 70 and FIG. 83 also includes a consensus amino acid sequence determined by aligning homologous and/or orthologous amino acid sequences with the amino acid sequence set forth in SEQ ID NO:432 or SEQ ID NO:540, respectively.

For example, the alignment in FIG. 70 provides the amino acid sequences of Lead CeresClone 37792 (SEQ ID NO:432), CeresClone:12970 (SEQ ID NO:433), and gi|62546191 (SEQ ID NO:434).

The alignment in FIG. 83 provides the amino acid sequences of Lead CeresClone 481915 (SEQ ID NO:540), CeresClone:38344 (SEQ ID NO:541), gi|7269595 (SEQ ID NO:542), gi|31322582 (SEQ ID NO:543), and gi|62546187 (SEQ ID NO:544).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 433-434, SEQ ID NOs:541-544, or the consensus sequence set forth in FIG. 70 or FIG. 83.

A regulatory protein can contain an SBP domain. SBP (SQUAMOSA-PROMOTER BINDING PROTEIN) domains are found in plant polypeptides. The SBP plant polypeptide domain is a sequence specific DNA-binding domain. Polypeptides with this domain probably function as transcription factors involved in the control of early flower development. The domain contains 10 conserved cysteine and histidine residues that are likely to be zinc ligands. SEQ ID NO:108 and SEQ ID NO:703 set forth the amino acid sequences of DNA clones, identified herein as Ceres CLONE ID no. 10375 (SEQ ID NO:107) and Ceres CLONE no. 37859 (SEQ ID NO:702), respectively, each of which is predicted to encode a polypeptide containing an SBP domain.

A regulatory protein can comprise the amino acid sequence set forth in SEQ ID NO:108 or SEQ ID NO:703. Alternatively, a regulatory protein can be a homolog, ortholog, or variant of the polypeptide having the amino acid sequence set forth in SEQ ID NO:108 or SEQ ID NO:703. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:108 or SEQ ID NO:703.

Amino acid sequences of homologs and/or orthologs of the polypeptide having the amino acid sequence set forth in SEQ ID NO:108 are provided in FIG. 16. FIG. 16 also includes a consensus amino acid sequence determined by aligning homologous and/or orthologous amino acid sequences with the amino acid sequence set forth in SEQ ID NO:108.

For example, the alignment in FIG. 16 provides the amino acid sequences of Lead CeresClone 10375 (SEQ ID NO:108), gi|30577630 (SEQ ID NO:109), CeresClone:538817 (SEQ ID NO:110), and gi|183866 (SEQ ID NO:111).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 109-111 or the consensus sequence set forth in FIG. 16.

A regulatory protein can contain a KE2 domain characteristic of KE2 family polypeptides. Members of this family have been suggested to contain a DNA binding leucine zipper motif. The yeast KE2 protein has been shown to be part of a polypeptide complex that promotes formation of functional alpha- and gamma-tubulin. SEQ ID NO:394 sets forth the amino acid sequence of a DNA clone, identified herein as Ceres CLONE ID no. 34060 (SEQ ID NO:393), that is predicted to encode a polypeptide containing a KE2 domain.

A regulatory protein can comprise the amino acid sequence set forth in SEQ ID NO:394. Alternatively, a regulatory protein can be a homolog, ortholog, or variant of the polypeptide having the amino acid sequence set forth in SEQ ID NO:394. For example, a regulatory protein can have an amino acid sequence with at least 55% sequence identity, e.g., 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:394.

Amino acid sequences of homologs and/or orthologs of the polypeptide having the amino acid sequence set forth in SEQ ID NO:394 are provided in FIG. 62. FIG. 62 also includes a consensus amino acid sequence determined by aligning homologous and/or orthologous amino acid sequences with the amino acid sequence set forth in SEQ ID NO:394.

For example, the alignment in FIG. 62 provides the amino acid sequences of Lead CeresClone 34060 (SEQ ID NO:394) with homologous and/or orthologous amino acid sequence CeresClone:810464 (SEQ ID NO:395).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NO:395 or the consensus sequence set forth in FIG. 62.

A regulatory protein can have a WD-40 repeat, also known as WD or beta-transducin repeats. WD-40 repeats are motifs that often terminate in a Trp-Asp (W-D) dipeptide. Polypeptides containing WD repeats have four to 16 repeating units, which are thought to form a circularized beta-propeller structure. WD-repeat polypeptides serve as an assembly platform for multiprotein complexes in which the repeating units serve as a rigid scaffold for polypeptide interactions. Examples of such complexes include G protein complexes, the beta subunits of which are beta-propellers; TAFII transcription factor complexes; and E3 ubiquitin ligase complexes. WD-repeat polypeptides form a large family of eukaryotic polypeptides implicated in a variety of functions ranging from signal transduction and transcription regulation to cell cycle control and apoptosis. SEQ ID NO:513 sets forth the amino acid sequence of a DNA clone, identified herein as Ceres CLONE ID no. 475689 (SEQ ID NO:512), that is predicted to encode a polypeptide containing a WD-40 repeat.

In some cases, a regulatory protein having a WD-40 repeat can also contain a zf-CCCH domain described above. SEQ ID NO:427 sets forth the amino acid sequence of a DNA clone, identified herein as Ceres CLONE ID no. 374674 (SEQ ID NO:426), that is predicted to encode a polypeptide containing a WD-40 repeat and a zf-CCCH domain.

A regulatory protein can comprise the amino acid sequence set forth in SEQ ID NO:513 or SEQ ID NO:427. Alternatively, a regulatory protein can be a homolog, ortholog, or variant of the polypeptide having the amino acid sequence set forth in SEQ ID NO:513 or SEQ ID NO:427. For example, a regulatory protein can have an amino acid sequence with at least 50% sequence identity, e.g., 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:513 or SEQ ID NO:427.

Amino acid sequences of homologs and/or orthologs of the polypeptide having the amino acid sequence set forth in SEQ ID NO:513 and SEQ ID NO:427 are provided in FIG. 81 and FIG. 69, respectively. Each of FIG. 81 and FIG. 69 also includes a consensus amino acid sequence determined by aligning homologous and/or orthologous amino acid sequences with the amino acid sequence set forth in SEQ ID NO:513 or SEQ ID NO:427, respectively.

For example, the alignment in FIG. 81 provides the amino acid sequences of Lead CeresClone 475689 (SEQ ID NO:513), gi|22324807 (SEQ ID NO:514), CeresClone: 1151902 (SEQ ID NO:515), g|10636051 (SEQ ID NO:516), gi|6752886 (SEQ ID NO:517), gi|2290532 (SEQ ID NO:518), CeresClone:783774 (SEQ ID NO:519), gi|37544703 (SEQ ID NO:520), gi|50251896 (SEQ ID NO:521), and gi|14270085 (SEQ ID NO:522).

The alignment in FIG. 69 provides the amino acid sequences of Lead CeresClone 374674 (SEQ ID NO:427), gi|10177733 (SEQ ID NO:428), CeresClone:18612 (SEQ ID NO:429), and CeresClone:1359803 (SEQ ID NO:430).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 514-522, SEQ ID NOs:428-430, or the consensus sequence set forth in FIG. 81 or FIG. 69.

A regulatory protein can contain a methyl-CpG binding domain (MBD). Regulatory proteins with a methyl-CpG binding domain, in association with other polypeptides, have preferential binding affinity to methylated DNA, which results in changes in chromatin structure leading to transcriptional activation or transcriptional repression of affected genes. SEQ ID NO:294 sets forth the amino acid sequence of a DNA clone, identified herein as Ceres CLONE ID no. 261609 (SEQ ID NO:293), that is predicted to encode a polypeptide containing a methyl-CpG binding domain.

In some cases, a regulatory protein can contain a methyl-CpG binding domain and a zf-CW domain. The zf-CW domain is predicted to be a highly specialized mononuclear four-cysteine zinc finger that plays a role in DNA binding and/or promoting polypeptide-polypeptide interactions in eukaryotic processes including chromatin methylation and early embryonic development. The zf-CW domain is found exclusively in vertebrates, vertebrate-infecting parasites, and higher plants. SEQ ID NO:305 sets forth the amino acid sequence of a DNA clone, identified herein as Ceres CLONE ID no. 283597 (SEQ ID NO:304), that is predicted to encode a polypeptide containing a methyl-CpG binding domain and a zf-CW domain.

A regulatory protein can comprise the amino acid sequence set forth in SEQ ID NO:294 or SEQ ID NO:305. Alternatively, a regulatory protein can be a homolog, ortholog, or variant of the polypeptide having the amino acid sequence set forth in SEQ ID NO:294 or SEQ ID NO:305. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:294 or SEQ ID NO:305.

Amino acid sequences of homologs and/or orthologs of the polypeptide having the amino acid sequence set forth in SEQ ID NO:305 are provided in FIG. 45. FIG. 45 also includes a consensus amino acid sequence determined by aligning homologous and/or orthologous amino acid sequences with the amino acid sequence set forth in SEQ ID NO:305.

For example, the alignment in FIG. 45 provides the amino acid sequences of Lead CeresClone 283597 (SEQ ID NO:305), CeresClone:40501 (SEQ ID NO:306) and CeresClone:407007 (SEQ ID NO:307).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 306-307 or the consensus sequence set forth in FIG. 45.

A regulatory protein can contain an HMG (high mobility group) box. HMG regulatory proteins can have one or more copies of an HMB-box motif or domain, and are involved in the regulation of DNA-dependent processes such as transcription, replication, and strand repair, all of which require the bending and unwinding of chromatin. Many of these proteins regulate gene expression. SEQ ID NO:183, SEQ ID NO:359, SEQ ID NO:654, and SEQ ID NO:684 set forth the amino acid sequences of DNA clones, identified herein as Ceres CLONE ID no. 16204 (SEQ ID NO:182), Ceres CLONE ID no. 333753 (SEQ ID NO:358), Ceres CLONE no. 11615 (SEQ ID NO:653), and Ceres CLONE no. 27175 (SEQ ID NO:683), respectively, each of which is predicted to encode a polypeptide containing an HMG box.

A regulatory protein can comprise the amino acid sequence set forth in SEQ ID NO:183, SEQ ID NO:359, SEQ ID NO:654, or SEQ ID NO:684. Alternatively, a regulatory protein can be a homolog, ortholog, or variant of the polypeptide having the amino acid sequence set forth in SEQ ID NO:183, SEQ ID NO:359, SEQ ID NO:654, or SEQ ID NO:684. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:183, SEQ ID NO:359, SEQ ID NO:654, or SEQ ID NO:684.

Amino acid sequences of homologs and/or orthologs of the polypeptide having the amino acid sequence set forth in SEQ ID NO:359 are provided in FIG. 56. FIG. 56 also includes a consensus amino acid sequence determined by aligning homologous and/or orthologous amino acid sequences with the amino acid sequence set forth in SEQ ID NO:359.

For example, the alignment in FIG. 56 provides the amino acid sequences of Lead CeresClone 333753 (SEQ ID NO:359), gi|17017392 (SEQ ID NO:360) and gi|50726318 (SEQ ID NO:361).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 360-361 or the consensus sequence set forth in FIG. 56.

A regulatory protein can contain an HhH-GPD domain and an OGG_N domain. The HhH-GPD domain is characteristic of an HhH-GPD superfamily base excision DNA repair polypeptide. The name of the HhH-GPD domain is derived from the hallmark helix-hairpin-helix and Gly/Pro rich loop followed by a conserved aspartate. The HhH-GPD domain is found in a diverse range of structurally related DNA repair polypeptides that include endonuclease III and DNA glycosylase MutY, an A/G-specific adenine glycosylase. The HhH-GPD family also includes DNA-3-methyladenine glycosylase II, 8-oxoguanine DNA glycosylases, and other members of the AlkA family. The OGG_N domain, which is organized into a single copy of a TBP-like fold, is found in the N-terminus of 8-oxoguanine DNA glycosylase, the enzyme responsible for the process which leads to the removal of 8-oxoguanine residues from DNA. The 8-oxoguanine DNA glycosylase enzyme has DNA glycosylase and DNA lyase activity. SEQ ID NO:12 sets forth the amino acid sequence of a DNA clone, identified herein as cDNA ID 23486285 (SEQ ID NO:11), that is predicted to encode a polypeptide having an HhH-GPD domain and an OGG_N domain.

A regulatory protein can comprise the amino acid sequence set forth in SEQ ID NO:12. Alternatively, a regulatory protein can be a homolog, ortholog, or variant of the polypeptide having the amino acid sequence set forth in SEQ ID NO:12. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:12.

A regulatory protein can contain an SSB domain characteristic of a polypeptide belonging to the single-strand binding protein family. The SSB family includes single stranded binding proteins and also the primosomal replication protein N (PriB). The *Escherichia coli* single-strand binding protein (gene ssb), also known as the helix-destabilizing protein, binds tightly, as a homotetramer, to single-stranded DNA and plays an important role in DNA replication, recombination, and repair. SEQ ID NO:14 sets forth the amino acid sequence of a DNA clone, identified herein as Ceres CDNA ID no. 23492765 (SEQ ID NO:13), that is predicted to encode a polypeptide containing an SSB domain.

A regulatory protein can comprise the amino acid sequence set forth in SEQ ID NO:14. Alternatively, a regulatory protein can be a homolog, ortholog, or variant of the polypeptide having the amino acid sequence set forth in SEQ ID NO:14. For example, a regulatory protein can have an amino acid sequence with at least 45% sequence identity, e.g., 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:14.

Amino acid sequences of homologs and/or orthologs of the polypeptide having the amino acid sequence set forth in SEQ ID NO:14 are provided in FIG. 2. FIG. 2 also includes a consensus amino acid sequence determined by aligning homologous and/or orthologous amino acid sequences with the amino acid sequence set forth in SEQ ID NO:14.

For example, the alignment in FIG. 2 provides the amino acid sequences of Lead CDNA ID 23492765 (SEQ ID NO:14), CeresClone:381106 (SEQ ID NO:15), gi|55297106 (SEQ ID NO:16), and gi|34911652 (SEQ ID NO:17).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 15-17 or the consensus sequence set forth in FIG. 2.

A regulatory protein can have one or more RNA recognition motifs, also known as RRM, RBD, or RNP domains. For example, a regulatory protein can have an RRM_1 RNA recognition motif. RNA recognition motifs are found in a variety of RNA binding polypeptides, including heterogeneous nuclear ribonucleoproteins (hnRNPs), polypeptides implicated in regulation of alternative splicing, and polypeptide components of small nuclear ribonucleoproteins (snRNPs). The RRM motif also appears in a few single stranded DNA binding polypeptides. The RRM structure consists of four strands and two helices arranged in an alpha/beta sandwich, with a third helix present during RNA binding in some cases. SEQ ID NO:78, SEQ ID NO:163, SEQ ID NO:319, SEQ ID NO:341, SEQ ID NO:363, SEQ ID NO:399, SEQ ID NO:642, SEQ ID NO:772, and SEQ ID NO:636 set forth the amino acid sequences of DNA clones, identified herein as Ceres CDNA ID no. 23546315 (SEQ ID NO:77), Ceres CLONE ID no. 14246 (SEQ ID NO:162), Ceres CLONE ID no. 29637 (SEQ ID NO:318), Ceres CLONE ID no. 319760 (SEQ ID NO:340), Ceres CLONE ID no. 335011 (SEQ ID NO:362), 34406 (SEQ ID NO:398), Ceres CLONE ID no. 10976 (SEQ ID NO:641), Ceres CLONE ID no. 266712 (SEQ ID NO:771), and Ceres CLONE ID no. 3774 (SEQ ID NO:635), respectively, each of which is predicted to encode a polypeptide containing an RRM_1 domain.

In some cases, a regulatory protein can contain more than one RNA recognition motif. SEQ ID NO:177 sets forth the amino acid sequence of a DNA clone, identified herein as Ceres CLONE ID no. 158155 (SEQ ID NO:176), that is predicted to encode a polypeptide containing two RRM_1 domains.

A regulatory protein can comprise the amino acid sequence set forth in SEQ ID NO:78, SEQ ID NO:163, SEQ ID NO:319, SEQ ID NO:341, SEQ ID NO:363, SEQ ID NO:399, SEQ ID NO:642, SEQ ID NO:772, SEQ ID NO:636, or SEQ ID NO:177. Alternatively, a regulatory protein can be a homolog, ortholog, or variant of the polypeptide having the amino acid sequence set forth in SEQ ID NO:78, SEQ ID NO:163, SEQ ID NO:319, SEQ ID NO:341, SEQ ID NO:363, SEQ ID NO:399, SEQ ID NO:642, SEQ ID NO:772, SEQ ID NO:636, or SEQ ID NO:177. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:78, SEQ ID NO:163, SEQ ID NO:319, SEQ ID NO:341, SEQ ID NO:363, SEQ ID NO:399, SEQ ID NO:642, SEQ ID NO:772, SEQ ID NO:636, or SEQ ID NO:177.

Amino acid sequences of homologs and/or orthologs of the polypeptide having the amino acid sequence set forth in SEQ ID NO:163, SEQ ID NO:319, SEQ ID NO:341, SEQ ID NO:363, SEQ ID NO:399, SEQ ID NO:642, SEQ ID NO:772, SEQ ID NO:636, and SEQ ID NO:177 are provided in FIG. 26, FIG. 48, FIG. 52, FIG. 57, FIG. 63, FIG. 99, FIG. 111, FIG. 98, and FIG. 28, respectively. Each of FIG. 26, FIG. 48, FIG. 52, FIG. 57, FIG. 63, FIG. 99, FIG. 111, FIG. 98, and FIG. 28 also includes a consensus amino acid sequence determined by aligning homologous and/or orthologous amino acid sequences with the amino acid sequence set forth in SEQ ID NO:163, SEQ ID NO:319, SEQ ID NO:341, SEQ ID NO:363, SEQ ID NO:399, SEQ ID NO:642, SEQ ID NO:772, SEQ ID NO:636, or SEQ ID NO:177, respectively.

For example, the alignment in FIG. 26 provides the amino acid sequences of Lead CeresClone 14246 (SEQ ID NO:163), CeresClone:511197 (SEQ ID NO:164), gi|311952 (SEQ ID NO:165), gi|20005 (SEQ ID NO:166), CeresClone:1537388 (SEQ ID NO:167), gi|50934311 (SEQ ID NO:168), and gi|3550485 (SEQ ID NO:169).

The alignment in FIG. 48 provides the amino acid sequences of Lead CeresClone 29637 (SEQ ID NO:319), gi|34896798 (SEQ ID NO:320).

The alignment in FIG. 52 provides the amino acid sequences of Lead CeresClone 319760 (SEQ ID NO:341) and CeresClone:819279 (SEQ ID NO:342).

The alignment in FIG. 57 provides the amino acid sequences of Lead CeresClone 335011 (SEQ ID NO:363), CeresClone:553817 (SEQ ID NO:364), CeresClone:780844 (SEQ ID NO:365), and gi|50925969 (SEQ ID NO:366).

The alignment in FIG. 63 provides the amino acid sequences of Lead CeresClone 34406 (SEQ ID NO:399), gi|12323160 (SEQ ID NO:400) and CeresClone:1604448 (SEQ ID NO:401).

The alignment in FIG. 99 provides the amino acid sequences of Lead CeresClone 10976 (SEQ ID NO:642), gi|12325357 (SEQ ID NO:643), CeresClone:967560 (SEQ ID NO:644), CeresGdna:1439730 (SEQ ID NO:646), CeresClone:626831 (SEQ ID NO:647), gi|30524687 (SEQ ID NO:648), gi|76573355 (SEQ ID NO:649), gi|68037220 (SEQ ID NO:650), CeresClone:615951 (SEQ ID NO:651), and gi|50540745 (SEQ ID NO:652).

The alignment in FIG. 111 provides the amino acid sequences of Lead CeresClone 266712 (SEQ ID NO:772), CeresClone:1120014 (SEQ ID NO:783), CeresClone:

1066826 (SEQ ID NO:784), gi|469070 (SEQ ID NO:786), CeresClone:584963 (SEQ ID NO:787), and gi|6911142 (SEQ ID NO:793). Other homologs and/or orthologs of SEQ ID NO:772 include Ceres CLONE ID no. 27704 (SEQ ID NO:773), Ceres CLONE ID no. 102714 (SEQ ID NO:774), Ceres CLONE ID no. 109853 (SEQ ID NO:775), Public GI no. 30692254 (SEQ ID NO:776), Ceres CLONE ID no. 159471 (SEQ ID NO:777), Ceres CLONE ID no. 1003147 (SEQ ID NO:778), Ceres CLONE ID no. 1003205 (SEQ ID NO:779), Ceres CLONE ID no. 117120 (SEQ ID NO:780), Ceres CLONE ID no. 16929 (SEQ ID NO:781), Ceres CLONE ID no. 1014920 (SEQ ID NO:782), Ceres CLONE ID no. 1012467 (SEQ ID NO:785), Ceres CLONE ID no. 934677 (SEQ ID NO:788), Ceres CLONE ID no. 751438 (SEQ ID NO:789), Ceres CLONE ID no. 702509 (SEQ ID NO:790), Ceres CLONE ID no. 726494 (SEQ ID NO:791), Ceres CLONE ID no. 786742 (SEQ ID NO:792), Ceres CLONE ID no. 928422 (SEQ ID NO:794), Ceres CLONE ID no. 771071 (SEQ ID NO:795), Ceres CLONE ID no. 1017780 (SEQ ID NO:796), and Ceres CLONE ID no. 617277 (SEQ ID NO:797).

The alignment in FIG. 98 provides the amino acid sequences of Lead CeresClone 3774 (SEQ ID NO:636) and CeresClone:1035997 (SEQ ID NO:637). Other homologs and/or orthologs of SEQ ID NO:636 include Ceres CLONE ID no. 982730 (SEQ ID NO:638).

Figure 28:
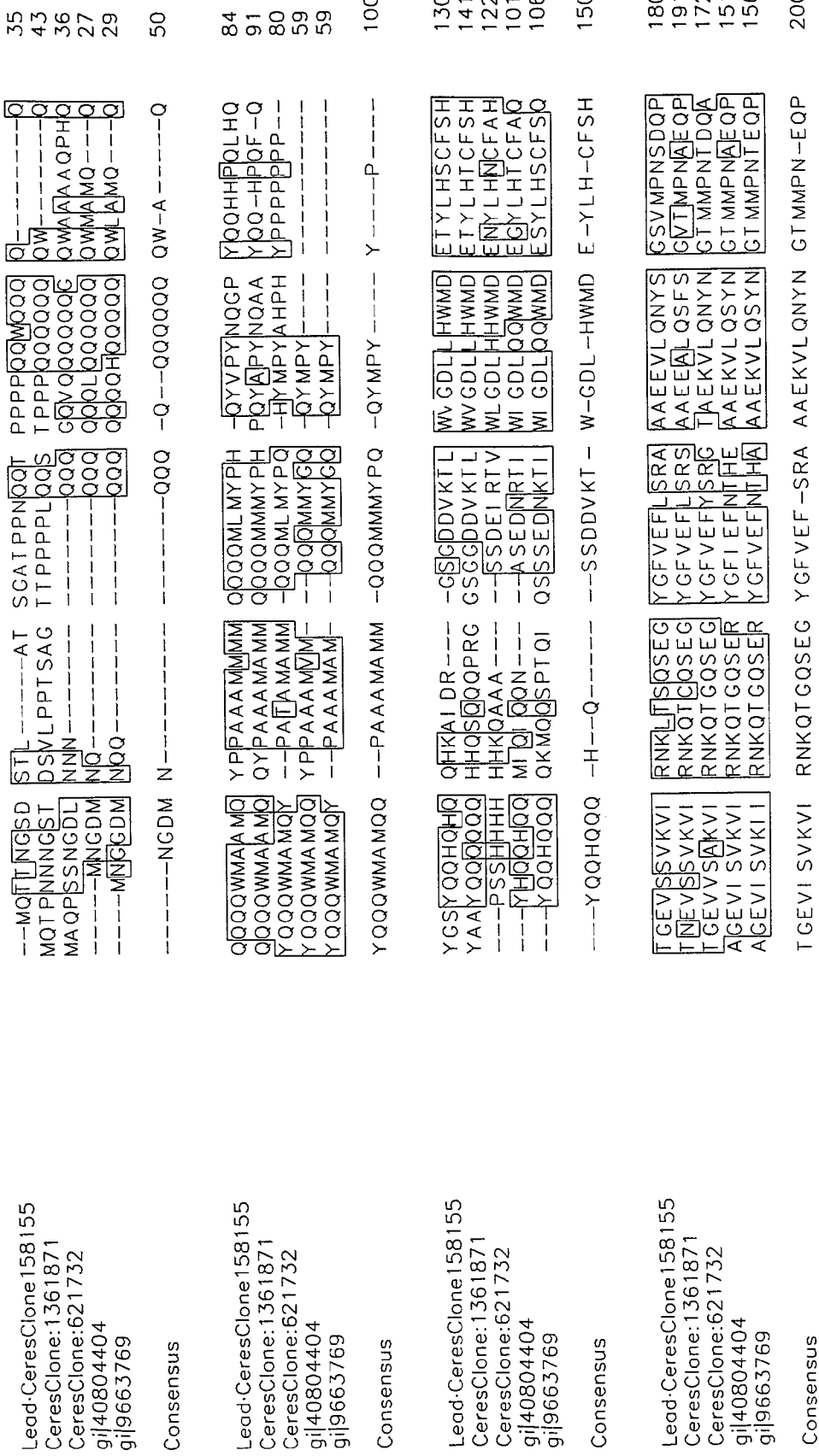
FIG. 28 is an alignment of the amino acid sequence of Lead CeresClone 158155 (SEQ ID NO:177) with homologous and/or orthologous amino acid sequences CeresClone:1361871 (SEQ ID NO:178), CeresClone:621732 (SEQ ID NO:179), gi|40804404 (SEQ ID NO:180), and gi|9663769 (SEQ ID NO:181). The consensus sequence determined by the alignment is set forth.

The alignment in FIG. 28 provides the amino acid sequences of Lead CeresClone 158155 (SEQ ID NO:177), CeresClone:1361871 (SEQ ID NO:178), CeresClone:621732 (SEQ ID NO:179), gi|40804404 (SEQ ID NO:180), and gi|9663769 (SEQ ID NO:181).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 164-169, SEQ ID NO:320, SEQ ID NO:342, SEQ ID NOs:364-366, SEQ ID NOs:400-401, SEQ ID NO:643-644, SEQ ID NOs:646-652, SEQ ID NOs:773-797, SEQ ID NOs:637-640, SEQ ID NOs:178-181, or the consensus sequence set forth in FIG. 26, FIG. 48, FIG. 52, FIG. 57, FIG. 63, FIG. 99, FIG. 111, FIG. 98, or FIG. 28.

A regulatory protein can have a G-patch domain. The D111/G-patch domain is a short conserved region of about 40 amino acids that occurs in a number of putative RNA-binding proteins, including tumor suppressor and DNA-damage-repair proteins. The G-patch domain may, therefore, have an RNA binding function. There are seven highly conserved glycine residues in the G-patch domain. SEQ ID NO:115 and SEQ ID NO:355 set forth the amino acid sequences of DNA clones, identified herein as Ceres CLONE ID no. 108509 (SEQ ID NO:114) and Ceres CLONE ID no. 333416 (SEQ ID NO:354), respectively, each of which is predicted to encode a polypeptide containing a G-patch domain.

A regulatory protein can comprise the amino acid sequence set forth in SEQ ID NO:115 or SEQ ID NO:355. Alternatively, a regulatory protein can be a homolog, ortholog, or variant of the polypeptide having the amino acid sequence set forth in SEQ ID NO:115 or SEQ ID NO:355. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:115 or SEQ ID NO:355.

Amino acid sequences of homologs and/or orthologs of the polypeptide having the amino acid sequence set forth in SEQ ID NO:115 and SEQ ID NO:355 are provided in FIG. 17 and FIG. 55, respectively. Each of FIG. 17 and FIG. 55 also includes a consensus amino acid sequence determined by aligning homologous and/or orthologous amino acid sequences with the amino acid sequence set forth in SEQ ID NO:115 or SEQ ID NO:355, respectively.

For example, the alignment in FIG. 17 provides the amino acid sequences of Lead CeresClone 108509 (SEQ ID NO:115), CeresClone:764678 (SEQ ID NO:116) and CeresClone:333416 (SEQ ID NO:117).

The alignment in FIG. 55 provides the amino acid sequences of Lead CeresClone 333416 (SEQ ID NO:355), CeresClone:108509 (SEQ ID NO:356) and CeresClone:764678 (SEQ ID NO:357).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 116-117, SEQ ID NOs:356-357, or the consensus sequence set forth in FIG. 17 or FIG. 55.

A regulatory protein can have an S1 RNA binding domain. The S1 domain was originally identified in ribosomal protein S1 but is found in a wide range of RNA-associated polypeptides. The structure of the S1 domain, which has on OB-fold, is very similar to that of cold shock nucleic acid-binding polypeptides. SEQ ID NO:86 sets forth the amino acid sequence of a DNA clone, identified herein as Ceres CDNA ID no. 23651543 (SEQ ID NO:85), that is predicted to encode a polypeptide containing an S1 RNA binding domain.

A regulatory protein can comprise the amino acid sequence set forth in SEQ ID NO:86. Alternatively, a regulatory protein can be a homolog, ortholog, or variant of the polypeptide having the amino acid sequence set forth in SEQ ID NO:86. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:86.

A regulatory protein can contain one or more domains characteristic of a helicase polypeptide. For example, a regulatory protein can contain a DEAD domain characteristic of DEAD/DEAH box helicase polypeptides. Members of the DEAD/DEAH box helicase polypeptide family include the DEAD and DEAH box helicases, which are involved in unwinding nucleic acids. The DEAD box helicases are involved in various aspects of RNA metabolism, including nuclear transcription, pre in RNA splicing, ribosome biogenesis, nucleocytoplasmic transport, translation, RNA decay and organellar gene expression. SEQ ID NO:451 sets forth the amino acid sequence of a DNA clone, identified herein as Ceres CLONE ID no. 389585 (SEQ ID NO:450), that is predicted to encode a polypeptide containing a DEAD domain.

In some cases, a regulatory protein can contain a DEAD domain and a Helicase_C domain. The Helicase_C, or helicase conserved C-terminal, domain is found in a wide variety of helicases and related polypeptides. The Helicase_C domain may be an integral part of the helicase rather than an autonomously folding unit. SEQ ID NO:2, SEQ ID NO:312, and SEQ ID NO:467 set forth the amino acid sequences of DNA clones, identified herein as Ceres CDNA ID no. 13653045 (SEQ ID NO:1), Ceres CLONE ID no. 29310 (SEQ ID NO:311), and Ceres CLONE ID no. 3997 (SEQ ID NO:466), respectively, each of which is predicted to encode a polypeptide containing a DEAD domain and a Helicase_C domain.

A regulatory protein can comprise the amino acid sequence set forth in SEQ ID NO:451, SEQ ID NO:2, SEQ ID NO:312, or SEQ ID NO:467. Alternatively, a regulatory protein can be a homolog, ortholog, or variant of the polypeptide having the amino acid sequence set forth in SEQ ID NO:451, SEQ ID NO:2, SEQ ID NO:312, or SEQ ID NO:467. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:451, SEQ ID NO:2, SEQ ID NO:312, or SEQ ID NO:467.

Amino acid sequences of homologs and/or orthologs of the polypeptide having the amino acid sequence set forth in SEQ ID NO:312 and SEQ ID NO:467 are provided in FIG. 47 and FIG. 74, respectively. Each of FIG. 47 and FIG. 74 also includes a consensus amino acid sequence determined by aligning homologous and/or orthologous amino acid sequences with the amino acid sequence set forth in SEQ ID NO:312 or SEQ ID NO:467, respectively.

For example, the alignment in FIG. 47 provides the amino acid sequences of Lead CeresClone 29310 (SEQ ID NO:312), CeresClone:3997 (SEQ ID NO:313), gi|19697 (SEQ ID NO:314), gi|2119938 (SEQ ID NO:315), gi|485943 (SEQ ID NO:316), and gi|38564733 (SEQ ID NO:317).

The alignment in FIG. 74 provides the amino acid sequences of Lead CeresClone 3997 (SEQ ID NO:467), CeresClone:30700 (SEQ ID NO:468), gi|19698881 (SEQ ID NO:469), gi|19697 (SEQ ID NO:470), gi|2119938 (SEQ ID NO:471), gi|485943 (SEQ ID NO:472), gi|2119932 (SEQ ID NO:473), and gi|53792733 (SEQ ID NO:474).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 313-317, SEQ ID NOs:468-474, or the consensus sequence set forth in FIG. 47, or FIG. 74.

A regulatory protein can contain a GRP domain characteristic of a polypeptide belonging to the glycine-rich protein family. This family of polypeptides includes several glycine-rich proteins as well as nodulins 16 and 24. The family also contains polypeptides that are induced in response to various stresses. Some of the polypeptides that have a glycine-rich domain (i.e., GRPs) are capable of binding to RNA, potentially affecting the stability and translatability of bound RNAs. SEQ ID NO:210, SEQ ID NO:476, and SEQ ID NO:712 set forth the amino acid sequences of DNA clones, identified herein as Ceres CLONE ID no. 207629 (SEQ ID NO:209), Ceres CLONE ID no. 39985 (SEQ ID NO:475), and Ceres CLONE no. 92991 (SEQ ID NO:711), respectively, each of which is predicted to encode a polypeptide containing a GRP domain.

A regulatory protein can comprise the amino acid sequence set forth in SEQ ID NO:210, SEQ ID NO:476, or SEQ ID NO:712. Alternatively, a regulatory protein can be a homolog, ortholog, or variant of the polypeptide having the amino acid sequence set forth in SEQ ID NO:210, SEQ ID NO:476, or SEQ ID NO:712. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:210, SEQ ID NO:476, or SEQ ID NO:712.

Amino acid sequences of homologs and/or orthologs of the polypeptide having the amino acid sequence set forth in SEQ ID NO:210, SEQ ID NO:476, and SEQ ID NO:712 are provided in FIG. 32, FIG. 75, and FIG. 106, respectively. Each of FIG. 32, FIG. 75, and FIG. 106 also includes a consensus amino acid sequence determined by aligning homologous and/or orthologous amino acid sequences with the amino acid sequence set forth in SEQ ID NO:210, SEQ ID NO:476, or SEQ ID NO:712, respectively.

For example, the alignment in FIG. 32 provides the amino acid sequences of Lead CeresClone 207629 (SEQ ID NO:210), CeresClone:118184 (SEQ ID NO:211), CeresClone:1006473 (SEQ ID NO:212), CeresClone:24667 (SEQ ID NO:213), CeresClone:12459 (SEQ ID NO:214), CeresClone:1354021 (SEQ ID NO:215), and CeresClone:3244 (SEQ ID NO:216).

The alignment in FIG. 75 provides the amino acid sequences of Lead CeresClone 39985 (SEQ ID NO:476), CeresClone:20104 (SEQ ID NO:477), CeresClone:207629 (SEQ ID NO:478), gi|20197615 (SEQ ID NO:479), CeresClone:105261 (SEQ ID NO:480), and gi|21536606 (SEQ ID NO:481).

The alignment in FIG. 106 provides the amino acid sequences of Lead CeresClone 92991 (SEQ ID NO:712), CeresClone:106944 (SEQ ID NO:713), gi|289123 (SEQ ID NO:714), gi|54291465 (SEQ ID NO:715), gi|1405559 (SEQ ID NO:716), gi|585219 (SEQ ID NO:717), gi|19236 (SEQ ID NO:718), gi|18148 (SEQ ID NO:719), gi|2605889 (SEQ ID NO:720), gi|19547 (SEQ ID NO:721), and CeresClone:886552 (SEQ ID NO:722).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 211-216, SEQ ID NOs:477-481, SEQ ID NOs:713-722, or the consensus sequence set forth in FIG. 32, FIG. 75, or FIG. 106.

A regulatory protein can contain one or more tetratricopeptide repeats (TPRs). For example, a regulatory protein can contain a TPR_2 motif. Tetratricopeptide repeats, such as TPR_1, TPR_2, TPR_3, and TPR_4, are structural motifs that are present in a wide range of proteins and that mediate protein-protein interactions and assembly of multi-protein complexes. The TPR motif consists of 3 to 16 tandem repeats of 34 amino acid residues, although individual TPR motifs can be dispersed in the protein sequence. Sequence alignment of TPR domains has revealed a consensus sequence defined by a pattern of small and large amino acids. TPR motifs have been identified in various different organisms, ranging from bacteria to humans. Proteins containing TPRs are involved in a variety of biological processes, such as cell cycle regulation, transcriptional control, mitochondrial and peroxisomal protein transport, neurogenesis, and protein folding. SEQ ID NO:154 sets forth the amino acid sequence of a DNA clone, identified herein as Ceres CLONE ID no. 13930 (SEQ ID NO:153), that is predicted to encode a polypeptide containing a TPR_2 motif.

In some cases, a regulatory protein can contain a TPR_4 motif. SEQ ID NO:324 sets forth the amino acid sequence of a DNA clone, identified herein as Ceres CLONE ID no. 304523 (SEQ ID NO:323), that is predicted to encode a polypeptide containing a TPR_4 motif.

In some cases, a regulatory protein can contain a TPR_1 motif and a TPR_2 motif. SEQ ID NO:509 sets forth the amino acid sequence of a DNA clone, identified herein as Ceres CLONE ID no. 471089 (SEQ ID NO:508), that is predicted to encode a polypeptide containing a TPR_1 motif and a TPR_2 motif.

In some cases, a regulatory protein can contain a TPR_1 motif and two TPR_2 motifs. SEQ ID NO:408 sets forth the amino acid sequence of a DNA clone, identified herein as Ceres CLONE ID no. 35786 (SEQ ID NO:407), that is predicted to encode a polypeptide containing a TPR_1 motif and two TPR_2 motifs.

In some cases, a regulatory protein can contain a TPR_1 motif, a TPR_2 motif, and a Thioredoxin domain. Thioredoxins are small enzymes that participate in redox reactions through the reversible oxidation of an active center disulfide bond. SEQ ID NO:836 sets forth the amino acid sequence of a DNA clone, identified herein as Ceres CDNA no. 12575172 (SEQ ID NO:835), that is predicted to encode a polypeptide containing a TPR_1 motif, a TPR_2 motif, and a Thioredoxin domain.

A regulatory protein can comprise the amino acid sequence set forth in SEQ ID NO:154, SEQ ID NO:324, SEQ ID NO:509, SEQ ID NO:408, or SEQ ID NO:836. Alternatively, a regulatory protein can be a homolog, ortholog, or variant of the polypeptide having the amino acid sequence set forth in SEQ ID NO:154, SEQ ID NO:324, SEQ ID NO:509, SEQ ID NO:408, or SEQ ID NO:836. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:154, SEQ ID NO:324, SEQ ID NO:509, SEQ ID NO:408, or SEQ ID NO:836.

Amino acid sequences of homologs and/or orthologs of the polypeptide having the amino acid sequence set forth in SEQ ID NO:324, SEQ ID NO:509, SEQ ID NO:408, and SEQ ID NO:836 are provided in FIG. 49, FIG. 80, FIG. 65, and FIG. 113, respectively. Each of FIG. 49, FIG. 80, FIG. 65, and FIG. 113 also includes a consensus amino acid sequence determined by aligning homologous and/or orthologous amino acid sequences with the amino acid sequence set forth in SEQ ID NO:324, SEQ ID NO:509, SEQ ID NO:408, or SEQ ID NO:836, respectively.

For example, the alignment in FIG. 49 provides the amino acid sequences of Lead CeresClone 304523 (SEQ ID NO:324), CeresClone:481452 (SEQ ID NO:325) and gi|52353366 (SEQ ID NO:326).

The alignment in FIG. 80 provides the amino acid sequences of Lead CeresClone 471089 (SEQ ID NO:509), gi|21537266 (SEQ ID NO:510) and CeresClone:246144 (SEQ ID NO:511).

The alignment in FIG. 65 provides the amino acid sequences of Lead CeresClone 35786 (SEQ ID NO:408), CeresClone:288714 (SEQ ID NO:409) and gi|50904559 (SEQ ID NO:410).

The alignment in FIG. 113 provides the amino acid sequences of Lead cDNA ID 12575172 (SEQ ID NO:836) and CeresGdna:1519981 (SEQ ID NO:838).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 325-326, SEQ ID NOs:510-511, SEQ ID NOs:409-410, SEQ ID NO:838, or the consensus sequence set forth in FIG. 49, FIG. 80, FIG. 65, or FIG. 113.

A regulatory protein can contain a BTB/POZ domain and a MATH domain. The BTB (for BR-C, ttk, and bab) or POZ (for Pox virus and zinc finger) domain is present near the N-terminus of some zinc finger (zf-C2H2) polypeptides and is also found in polypeptides that contain the Kelch_1 motif. The BTB/POZ domain mediates homomeric dimerization and, in some instances, heteromeric dimerization. POZ domains from several zinc finger polypeptides have been shown to mediate transcriptional repression and to interact with components of histone deacetylase co-repressor complexes including N-CoR and SMRT. The Meprin and TRAF-homology (MATH) domain is a conserved region of about 180 residues shared by the intracellular TRAF and extracellular meprin polypeptides. Meprins are mammalian tissue-specific metalloendopeptidases of the astacin family implicated in developmental, normal, and pathological processes by hydrolyzing a variety of polypeptides. TRAF polypeptides were isolated based on their ability to interact with TNF receptors. The MATH domain of TRAF polypeptides is necessary and sufficient for self-association and receptor interaction. SEQ ID NO:730 sets forth the amino acid sequence of a DNA clone, identified herein as Ceres CLONE no. 113719 (SEQ ID NO:729), that is predicted to encode a polypeptide containing a BTB/POZ domain and a MATH domain.

A regulatory protein can comprise the amino acid sequence set forth in SEQ ID NO:730. Alternatively, a regulatory protein can be a homolog, ortholog, or variant of the polypeptide having the amino acid sequence set forth in SEQ ID NO:730. For example, a regulatory protein can have an amino acid sequence with at least 50% sequence identity, e.g., 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:730.

Amino acid sequences of homologs and/or orthologs of the polypeptide having the amino acid sequence set forth in SEQ ID NO:730 are provided in FIG. 107. FIG. 107 also includes a consensus amino acid sequence determined by aligning homologous and/or orthologous amino acid sequences with the amino acid sequence set forth in SEQ ID NO:730.

For example, the alignment in FIG. 107 provides the amino acid sequences of Lead CeresClone 113719 (SEQ ID NO:730), CeresClone:713993 (SEQ ID NO:732), CeresGdna:1513206 (SEQ ID NO:734), gi|50939715 (SEQ ID NO:735), and CeresClone:288779 (SEQ ID NO:736). Other homologs and/or orthologs of SEQ ID NO:730 include Public GI no. 79516480 (SEQ ID NO:731).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 731-732, SEQ ID NOs:734-736, or the consensus sequence set forth in FIG. 107.

A regulatory protein can contain a Pterin_4a domain characteristic of a Pterin 4 alpha carbinolamine dehydratase polypeptide. Pterin 4 alpha carbinolamine dehydratase is also known as DCoH (dimerization cofactor of hepatocyte nuclear factor 1-alpha). DCoH is the dimerization cofactor of hepatocyte nuclear factor 1 (HNF-1) that functions as both a transcriptional coactivator and a pterin dehydratase. X-ray crystallographic studies have shown that the ligand binds at four sites per tetrameric enzyme, with little apparent conformational change in the protein. SEQ ID NO:607 sets forth the amino acid sequence of a DNA clone, identified herein as Ceres CLONE ID no. 8788 (SEQ ID NO:606), that is predicted to encode a polypeptide containing a Pterin_4a domain.

A regulatory protein can comprise the amino acid sequence set forth in SEQ ID NO:607. Alternatively, a regulatory protein can be a homolog, ortholog, or variant of the polypeptide having the amino acid sequence set forth in SEQ ID NO:607. For example, a regulatory protein can have an amino acid sequence with at least 45% sequence identity, e.g., 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:607.

Amino acid sequences of homologs and/or orthologs of the polypeptide having the amino acid sequence set forth in SEQ ID NO:607 are provided in FIG. 93. FIG. 93 also includes a consensus amino acid sequence determined by aligning homologous and/or orthologous amino acid sequences with the amino acid sequence set forth in SEQ ID NO:607.

For example, the alignment in FIG. 93 provides the amino acid sequences of Lead CeresClone 8788 (SEQ ID NO:607) with homologous and/or orthologous amino acid sequences CeresClone:1032823 (SEQ ID NO:608) and CeresClone:314156 (SEQ ID NO:609).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 608-609 or the consensus sequence set forth in FIG. 93.

A regulatory protein can contain a Response_reg domain. The response regulator receiver domain, which belongs to the CheY family, receives the signal from the sensor partner in the two-component system. The response regulator polypeptides act as phosphorylation-activated switches to affect a cellular response, usually by transcriptional regulation. Most of these polypeptides consist of two domains, an N-terminal response regulator receiver domain, and a variable C-terminal effector domain with DNA-binding activity. SEQ ID NO:618 sets forth the amino acid sequence of a DNA clone, identified herein as Ceres CLONE ID no. 968026 (SEQ ID NO:617), that is predicted to encode a polypeptide containing a Response_reg domain.

A regulatory protein can comprise the amino acid sequence set forth in SEQ ID NO:618. Alternatively, a regulatory protein can be a homolog, ortholog, or variant of the polypeptide having the amino acid sequence set forth in SEQ ID NO:618. For example, a regulatory protein can have an amino acid sequence with at least 65% sequence identity, e.g., 67%, 68%, 70%, 75%, 80%, 85%, 90%, 95%, 97%, 98%, or 99% sequence identity, to the amino acid sequence set forth in SEQ ID NO:618.

Amino acid sequences of homologs and/or orthologs of the polypeptide having the amino acid sequence set forth in SEQ ID NO:618 are provided in FIG. 95. FIG. 95 also includes a consensus amino acid sequence determined by aligning homologous and/or orthologous amino acid sequences with the amino acid sequence set forth in SEQ ID NO:618.

For example, the alignment in FIG. 95 provides the amino acid sequences of Lead CeresClone 968026 (SEQ ID NO:618) with homologous and/or orthologous amino acid sequences gi|28466913 (SEQ ID NO:619) and gi|4678318 (SEQ ID NO:620).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 619-620 or the consensus sequence set forth in FIG. 95.

A regulatory protein can contain a GASA domain characteristic of a polypeptide belonging to the GASA gibberellin regulated cysteine rich protein family. The expression of these polypeptides is up-regulated by the plant hormone gibberellin. Most of these gibberellin regulated polypeptides have a role in plant development. There are 12 conserved cysteine residues, making it possible for these proteins to possess six disulphide bonds. SEQ ID NO:22 sets forth the amino acid sequence of a DNA clone, identified herein as Ceres CDNA ID no. 23497949 (SEQ ID NO:21), that is predicted to encode a gibberellin regulated polypeptide.

A regulatory protein can comprise the amino acid sequence set forth in SEQ ID NO:22. Alternatively, a regulatory protein can be a homolog, ortholog, or variant of the polypeptide having the amino acid sequence set forth in SEQ ID NO:22. For example, a regulatory protein can have an amino acid sequence with at least 40% sequence identity, e.g., 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:22.

Figure 4:
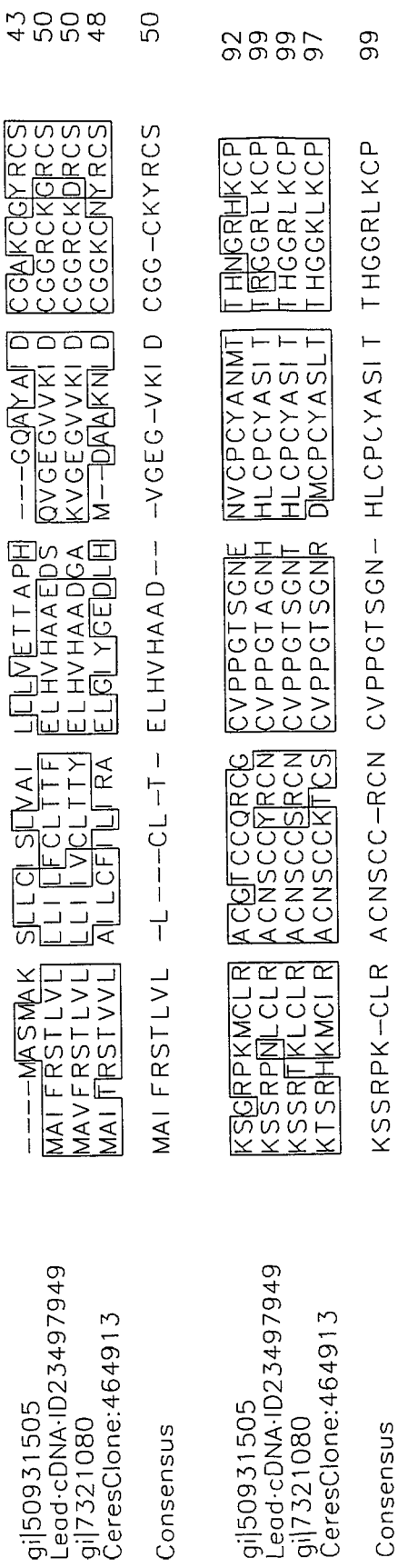
FIG. 4 is an alignment of the amino acid sequence of Lead cDNA ID 23497949 (SEQ ID NO:22) with homologous and/or orthologous amino acid sequences gi|7321080 (SEQ ID NO:23), CeresClone:464913 (SEQ ID NO:24), and gi|50931505 (SEQ ID NO:25). The consensus sequence determined by the alignment is set forth.

Amino acid sequences of homologs and/or orthologs of the polypeptide having the amino acid sequence set forth in SEQ ID NO:22 are provided in FIG. 4. FIG. 4 also includes a consensus amino acid sequence determined by aligning homologous and/or orthologous amino acid sequences with the amino acid sequence set forth in SEQ ID NO:22.

For example, the alignment in FIG. 4 provides the amino acid sequences of Lead cDNA ID 23497949 (SEQ ID NO:22), gi|7321080 (SEQ ID NO:23), CeresClone:464913 (SEQ ID NO:24), and gi|50931505 (SEQ ID NO:25).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 23-25 or the consensus sequence set forth in FIG. 4.

A regulatory protein can contain a Mov34 domain characteristic of a Mov34/MPN/PAD-1 family polypeptide. Mov34 polypeptides are reported to act as regulatory subunits of the 26 proteasome, which is involved in the ATP-dependent degradation of ubiquitinated proteins. Mov34 domains are found in the N-terminus of the proteasome regulatory subunits, eukaryotic initiation factor 3 (eIF3) subunits, and regulators of transcription factors. SEQ ID NO:92, SEQ ID NO:309, SEQ ID NO:488, and SEQ ID NO:820 set forth the amino acid sequences of DNA clones, identified herein as Ceres CDNA ID no. 24374230 (SEQ ID NO:91), Ceres CLONE ID no. 286402 (SEQ ID NO:308), Ceres CLONE ID no. 42713 (SEQ ID NO:487), and Ceres CLONE no. 473126 (SEQ ID NO:819), respectively, each of which is predicted to encode a polypeptide containing a Mov34 domain.

A regulatory protein can comprise the amino acid sequence set forth in SEQ ID NO:92, SEQ ID NO:309, SEQ ID NO:488, or SEQ ID NO:820. Alternatively, a regulatory protein can be a homolog, ortholog, or variant of the polypeptide having the amino acid sequence set forth in SEQ ID NO:92, SEQ ID NO:309, SEQ ID NO:488, or SEQ ID NO:820. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:92, SEQ ID NO:309, SEQ ID NO:488, or SEQ ID NO:820.

Amino acid sequences of homologs and/or orthologs of the polypeptide having the amino acid sequence set forth in SEQ ID NO:92, SEQ ID NO:309, and SEQ ID NO:488 are provided in FIG. 14, FIG. 46, and FIG. 77, respectively. Each of FIG. 14, FIG. 46, and FIG. 77 also includes a consensus amino acid sequence determined by aligning homologous and/or orthologous amino acid sequences with the amino acid sequence set forth in SEQ ID NO:92, SEQ ID NO:309, and SEQ ID NO:488, respectively.

For example, the alignment in FIG. 14 provides the amino acid sequences of Lead CDNA ID 24374230 (SEQ ID NO:92), CeresClone:1507510 (SEQ ID NO:93), Ceres-Clone:500887 (SEQ ID NO:94), and gi|50931081 (SEQ ID NO:95).

The alignment in FIG. 46 provides the amino acid sequences of Lead CeresClone 286402 (SEQ ID NO:309) and CeresClone:23276 (SEQ ID NO:310).

The alignment in FIG. 77 provides the amino acid sequences of Lead CeresClone 42713 (SEQ ID NO:488), gi|21700803 (SEQ ID NO:489), gi|3641312 (SEQ ID NO:490), CeresClone:529894 (SEQ ID NO:491), gi|3320379 (SEQ ID NO:492), gi|12002865 (SEQ ID NO:493), and gi|50929277 (SEQ ID NO:494).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 93-95, SEQ ID NO:310, SEQ ID NOs:489-494, or the consensus sequence set forth in FIG. 14, FIG. 46, or FIG. 77.

A regulatory protein can contain an Arf domain characteristic of polypeptides belonging to the ADP-ribosylation factor family. The small ADP ribosylation factor (Arf) GTP-binding polypeptides are major regulators of vesicle biogenesis in intracellular traffic. They are the founding members of a growing family that includes Arl (Arf-like), Arp (Arf-related proteins), and the remotely related Sar (Secretion-associated and Ras-related) polypeptides. Arf polypeptides cycle between inactive GDP-bound and active GTP-bound forms that bind selectively to effectors. Members of the ADP-ribosylation factor family may indirectly affect transcription through protein-protein interactions. SEQ ID NO:333 and SEQ ID NO:453 set forth the amino acid sequences of DNA clones, identified herein as Ceres CLONE ID no. 316638 (SEQ ID NO:332) and Ceres CLONE ID no. 39279 (SEQ ID NO:452), respectively, each of which is predicted to encode a polypeptide containing an Arf domain.

A regulatory protein can comprise the amino acid sequence set forth in SEQ ID NO:333 or SEQ ID NO:453. Alternatively, a regulatory protein can be a homolog, ortholog, or variant of the polypeptide having the amino acid sequence set forth in SEQ ID NO:333 or SEQ ID NO:453. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:333 or SEQ ID NO:453.

Amino acid sequences of homologs and/or orthologs of the polypeptide having the amino acid sequence set forth in SEQ ID NO:453 are provided in FIG. 73. FIG. 73 also includes a consensus amino acid sequence determined by aligning homologous and/or orthologous amino acid sequences with the amino acid sequence set forth in SEQ ID NO:453.

For example, the alignment in FIG. 73 provides the amino acid sequences of Lead CeresClone 39279 (SEQ ID NO:453), gi|32815939 (SEQ ID NO:454), gi|17380746 (SEQ ID NO:455), CeresClone:15416 (SEQ ID NO:456), gi|1076457 (SEQ ID NO:457), gi|499068 (SEQ ID NO:458), gi|2118462 (SEQ ID NO:459), CeresClone:789317 (SEQ ID NO:460), CeresClone:483433 (SEQ ID NO:461), gi|1370154 (SEQ ID NO:462), and gi|50947781 (SEQ ID NO:463).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 454-463 or the consensus sequence set forth in FIG. 73.

A regulatory protein can contain an ArfGap domain characteristic of a putative GTPase activating protein for Arf. ARF1-directed GTPase-activating polypeptides contain a characteristic zinc finger motif (Cys-x2-Cys-x(16,17)-x2-Cys) which displays some similarity to the C4-type GATA zinc finger. SEQ ID NO:630 sets forth the amino acid sequence of a DNA clone, identified herein as Ceres CLONE ID no. 99519 (SEQ ID NO:629), that is predicted to encode a polypeptide containing an ArfGap domain.

A regulatory protein can comprise the amino acid sequence set forth in SEQ ID NO:630. Alternatively, a regulatory protein can be a homolog, ortholog, or variant of the polypeptide having the amino acid sequence set forth in SEQ ID NO:630. For example, a regulatory protein can have an amino acid sequence with at least 45% sequence identity, e.g., 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:630.

Amino acid sequences of homologs and/or orthologs of the polypeptide having the amino acid sequence set forth in SEQ ID NO:630 are provided in FIG. 97. FIG. 97 also includes a consensus amino acid sequence determined by aligning homologous and/or orthologous amino acid sequences with the amino acid sequence set forth in SEQ ID NO:630.

For example, the alignment in FIG. 97 provides the amino acid sequences of Lead CeresClone 99519 (SEQ ID NO:630), CeresClone:478849 (SEQ ID NO:631), CeresClone:575526 (SEQ ID NO:632), CeresClone:282105 (SEQ ID NO:633), and gi|50510178 (SEQ ID NO:634).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 631-634 or the consensus sequence set forth in FIG. 97.

A regulatory protein can contain an MMR_HSR1 domain characteristic of a GTPase polypeptide belonging to a subfamily of GTP-binding polypeptides. Polypeptides representing this subfamily include human HSR1, which has been localized to the human MHC class I region and is highly homologous to a putative GTP-binding protein, MMR1 from mouse. SEQ ID NO:158 sets forth the amino acid sequence of a DNA clone, identified herein as Ceres CLONE ID no. 14234 (SEQ ID NO:157), that is predicted to encode a polypeptide containing an MMR_HSR1 domain.

A regulatory protein can comprise the amino acid sequence set forth in SEQ ID NO:158. Alternatively, a regulatory protein can be a homolog, ortholog, or variant of the polypeptide having the amino acid sequence set forth in SEQ ID NO:158. For example, a regulatory protein can have an amino acid sequence with at least 60% sequence identity, e.g., 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:158.

Amino acid sequences of homologs and/or orthologs of the polypeptide having the amino acid sequence set forth in SEQ ID NO:158 are provided in FIG. 25. FIG. 25 also includes a consensus amino acid sequence determined by aligning homologous and/or orthologous amino acid sequences with the amino acid sequence set forth in SEQ ID NO:158.

For example, the alignment in FIG. 25 provides the amino acid sequences of Lead CeresClone 14234 (SEQ ID NO:158), CeresClone:567499 (SEQ ID NO:159), CeresClone:361163 (SEQ ID NO:160), and gi|50912455 (SEQ ID NO:161).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 159-161 or the consensus sequence set forth in FIG. 25.

A regulatory protein can have an SNase domain characteristic of a Staphylococcal nuclease (SNase) homolog. The human cellular coactivator p100 contains four repeats, each of which is an SNase homolog. These repeats may mediate the single-stranded DNA-binding function of p100. SEQ ID NO:580 sets forth the amino acid sequence of a DNA clone, identified herein as Ceres CLONE ID no. 6066 (SEQ ID NO:579), that is predicted to encode a polypeptide containing an SNase domain.

A regulatory protein can comprise the amino acid sequence set forth in SEQ ID NO:580. Alternatively, a regulatory protein can be a homolog, ortholog, or variant of the polypeptide having the amino acid sequence set forth in SEQ ID NO:580. For example, a regulatory protein can have an amino acid sequence with at least 55% sequence identity, e.g., 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:580.

Amino acid sequences of homologs and/or orthologs of the polypeptide having the amino acid sequence set forth in SEQ ID NO:580 are provided in FIG. 89. FIG. 89 also includes a consensus amino acid sequence determined by aligning homologous and/or orthologous amino acid sequences with the amino acid sequence set forth in SEQ ID NO:580

For example, the alignment in FIG. 89 provides the amino acid sequences of Lead CeresClone 6066 (SEQ ID NO:580) with homologous and/or orthologous amino acid sequences gi|4586057 (SEQ ID NO:581), CeresClone:467480 (SEQ ID NO:582), and gi|18258 (SEQ ID NO:583).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 581-583 or the consensus sequence set forth in FIG. 89.

A regulatory protein can have a Lipoxygenase domain and a PLAT domain. Lipoxygenases are a class of iron-containing dioxygenases that catalyze the hydroperoxidation of lipids containing a cis,cis-1,4-pentadiene structure. Lipoxygenases are common in plants, where they may be involved in diverse aspects of plant physiology including growth and development, pest resistance, and senescence or responses to wounding. The PLAT (Polycystin-1, Lipoxygenase, Alpha-Toxin) domain, or LH2 (Lipoxygenase homology) domain, is found in a variety of membrane or lipid associated polypeptides, such as lipogenase enzymes that are involved at various steps in the biosynthesis of leukotrienes and use iron as the cofactor. The PLAT domain has a beta sandwich structure and may mediate membrane attachment via other protein binding partners. SEQ ID NO:807 sets forth the amino acid sequence of a DNA clone, identified herein as Ceres CLONE no. 362993 (SEQ ID NO:806), that is predicted to encode a polypeptide having a Lipoxygenase domain and a PLAT domain.

A regulatory protein can comprise the amino acid sequence set forth in SEQ ID NO:807. Alternatively, a regulatory protein can be a homolog, ortholog, or variant of the polypeptide having the amino acid sequence set forth in SEQ ID NO:807. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:807.

A regulatory protein can contain a p450 domain characteristic of a cytochrome P450 polypeptide. The cytochrome P450 enzymes constitute a superfamily of haem-thiolate proteins. P450 enzymes usually act as terminal oxidases in multicomponent electron transfer chains, called P450-containing monooxygenase systems, and are involved in metabolism of a plethora of both exogenous and endogenous compounds. The conserved core is composed of a coil referred to as the "meander," a four-helix bundle, helices J and K, and two sets of beta-sheets. These regions constitute the haem-binding loop (with an absolutely conserved cysteine that serves as the 5th ligand for the haem iron), the proton-transfer groove, and the absolutely conserved EXXR motif in helix K. SEQ ID NO:830 sets forth the amino acid sequence of a DNA clone, identified herein as Ceres CLONE no. 601862 (SEQ ID NO:829), that is predicted to encode a polypeptide containing a p450 domain.

A regulatory protein can comprise the amino acid sequence set forth in SEQ ID NO:830. Alternatively, a regulatory protein can be a homolog, ortholog, or variant of the polypeptide having the amino acid sequence set forth in SEQ ID NO:830. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:830.

A regulatory protein can contain a Pollen_Ole_e_I domain characteristic of pollen polypeptides belonging to the Ole e I family. There are a number of structurally related plant pollen polypeptides that are probably secreted and consist of about 145 residues. The sequences of these polypeptides contain six cysteine residues that seem to form disulphide bonds. SEQ ID NO:761 sets forth the amino acid sequence of a DNA clone, identified herein as Ceres CLONE no. 207834 (SEQ ID NO:760), that is predicted to encode a polypeptide containing a Pollen_Ole_e_I domain.

A regulatory protein can comprise the amino acid sequence set forth in SEQ ID NO:761. Alternatively, a regulatory protein can be a homolog, ortholog, or variant of the polypeptide having the amino acid sequence set forth in SEQ ID NO:761. For example, a regulatory protein can have an amino acid sequence with at least 40% sequence identity, e.g., 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:761.

Amino acid sequences of homologs and/or orthologs of the polypeptide having the amino acid sequence set forth in SEQ ID NO:761 are provided in FIG. 110. FIG. 110 also includes a consensus amino acid sequence determined by aligning homologous and/or orthologous amino acid sequences with the amino acid sequence set forth in SEQ ID NO:761.

For example, the alignment in FIG. 110 provides the amino acid sequences of Lead CeresClone 207834 (SEQ ID NO:761), CeresClone:384289 (SEQ ID NO:762), gi|50923969 (SEQ ID NO:763), gi|25990491 (SEQ ID NO:765), and CeresClone:710471 (SEQ ID NO:766). Other homologs and/or orthologs of SEQ ID NO:761 include Public GI no. 20310 (SEQ ID NO:764).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 762-766 or the consensus sequence set forth in FIG. 110.

A regulatory protein can contain a PsbP domain. The PsbP polypeptide family consists of the 23 kDa subunit of oxygen evolving system of photosystem II or PsbP from various plants, where it is encoded by the nuclear genome, and Cyanobacteria. Both PsbP and PsbQ are regulators that are necessary for the biogenesis of optically active PSII. The 23 KDa PsbP polypeptide is required for PSII to be fully operational in vivo. PsbP increases the affinity of the water oxidation site for chloride ions and provides the conditions required for high affinity binding of calcium ions. SEQ ID NO:840 and SEQ ID NO:656 set forth the amino acid sequences of DNA clones, identified herein as Ceres CDNA no. 12605556 (SEQ ID NO:839) and Ceres CLONE no. 16403 (SEQ ID NO:655), respectively, each of which is predicted to encode a polypeptide containing a PsbP domain.

A regulatory protein can comprise the amino acid sequence set forth in SEQ ID NO:840 or SEQ ID NO:656. Alternatively, a regulatory protein can be a homolog, ortholog, or variant of the polypeptide having the amino acid sequence set forth in SEQ ID NO:840 or SEQ ID NO:656. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:840 or SEQ ID NO:656.

Amino acid sequences of homologs and/or orthologs of the polypeptide having the amino acid sequence set forth in SEQ ID NO:840 and SEQ ID NO:656 are provided in FIG. 114 and FIG. 100, respectively. Each of FIG. 114 and FIG. 100 also includes a consensus amino acid sequence determined by aligning homologous and/or orthologous amino acid sequences with the amino acid sequence set forth in SEQ ID NO:840 or SEQ ID NO:656, respectively.

For example, the alignment in FIG. 114 provides the amino acid sequences of Lead cDNA ID 12605556 (SEQ ID NO:840), CeresGdna:1455463 (SEQ ID NO:842), gi|54290426 (SEQ ID NO:843), CeresClone:372747 (SEQ ID NO:844), CeresClone:553394 (SEQ ID NO:845), gi|34912704 (SEQ ID NO:846), and CeresClone:678505 (SEQ ID NO:847).

The alignment in FIG. 100 provides the amino acid sequences of Lead CeresClone 16403 (SEQ ID NO:656), CeresClone:1807796 (SEQ ID NO:657), CeresClone: 611156 (SEQ ID NO:658), CeresGdna:1464944 (SEQ ID NO:660), and CeresClone:1771837 (SEQ ID NO:661).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 842-847, SEQ ID NOs:657-658, SEQ ID NOs:660-661, or the consensus sequence set forth in FIG. 114 or FIG. 100.

A regulatory protein can have a Steroid_dh domain characteristic of a 3-oxo-5-alpha-steroid 4-dehydrogenase enzyme. The steroid 5-alpha-reductase enzyme, also known as 3-oxo-5-alpha-steroid 4-dehydrogenase, catalyzes the conversion of 3-oxo-5-alpha-steroid+acceptor to 3-oxo-delta (4)-steroid+reduced acceptor. The steroid 5-alpha-reductase enzyme is responsible for the formation of dihydrotestosterone. A related enzyme found in plants is DET2, a steroid reductase from *Arabidopsis*. Mutations in this enzyme cause defects in light-regulated development. SEQ ID NO:801 sets forth the amino acid sequence of a DNA clone, identified herein as Ceres CLONE no. 333618 (SEQ ID NO:800), that is predicted to encode a polypeptide containing a Steroid_dh domain.

A regulatory protein can comprise the amino acid sequence set forth in SEQ ID NO:801. Alternatively, a regulatory protein can be a homolog, ortholog, or variant of the polypeptide having the amino acid sequence set forth in SEQ ID NO:801. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:801.

A regulatory protein can contain a UDPG_MGDP_dh domain, a UDPG_MGDP_dh_C domain, and a UDPG_MGDP_dh_N domain characteristic of the central domain, UDP binding domain, and NAD binding domain, respectively, of a polypeptide belonging to the UDP-glucose/GDP-mannose dehydrogenase family. The UDP-glucose/GDP-mannose dehydrogenase polypeptides are enzymes that catalyze the NAD-dependent two-fold oxidation of an alcohol to an acid without the release of an aldehyde intermediate. In plants, UDP-glucose dehydrogenase is an important enzyme in the synthesis of hemicellulose and pectin. GDP-mannose dehydrogenase catalyzes the formation of GDP-mannuronic acid. SEQ ID NO:809 sets forth the amino acid sequence of a DNA clone, identified herein as Ceres CLONE no. 382867 (SEQ ID NO:808), that is predicted to encode a polypeptide containing contain a UDPG_MGDP_dh domain, a UDPG_MGDP_dh_C domain, and a UDPG_MGDP_dh_N domain.

A regulatory protein can comprise the amino acid sequence set forth in SEQ ID NO:809. Alternatively, a regulatory protein can be a homolog, ortholog, or variant of the polypeptide having the amino acid sequence set forth in SEQ ID NO:809. For example, a regulatory protein can have an amino acid sequence with at least 50% sequence identity, e.g., 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:809.

Amino acid sequences of homologs and/or orthologs of the polypeptide having the amino acid sequence set forth in SEQ ID NO:809 are provided in FIG. 112. FIG. 112 also includes a consensus amino acid sequence determined by aligning homologous and/or orthologous amino acid sequences with the amino acid sequence set forth in SEQ ID NO:809.

For example, the alignment in FIG. 112 provides the amino acid sequences of Lead CeresClone 382867 (SEQ ID NO:809), gi|50582697 (SEQ ID NO:810), gi|40317278 (SEQ ID NO:811), gi|48093459 (SEQ ID NO:812), gi|6136119 (SEQ ID NO:813), CeresGdna:1450213 (SEQ ID NO:815), gi|39939262 (SEQ ID NO:816), CeresClone: 9930 (SEQ ID NO:817), and gi|61338425 (SEQ ID NO:818).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 810-813, SEQ ID NOs:815-818, or the consensus sequence set forth in FIG. 112.

A regulatory protein can have a DUF298 domain. Members of the DUF298 polypeptide family contain a basic helix-loop-helix leucine zipper motif. The DUF298 domain is implicated in some aspect of neddylation of the cullin 3 family and has a possible role in the regulation of the polypeptide modifier Nedd8 E3 ligase. Neddylation is the process by which the C-terminal glycine of the ubiquitin-like protein Nedd8 is covalently linked to lysine residues in a polypeptide through an isopeptide bond. SEQ ID NO:624 sets forth the amino acid sequence of a DNA clone, identified herein as Ceres CLONE ID no. 99075 (SEQ ID NO:623), that is predicted to encode a polypeptide containing a DUF298 domain.

A regulatory protein can comprise the amino acid sequence set forth in SEQ ID NO:624. Alternatively, a regulatory protein can be a homolog, ortholog, or variant of the polypeptide having the amino acid sequence set forth in SEQ ID NO:624. For example, a regulatory protein can have an amino acid sequence with at least 55% sequence identity, e.g., 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:624.

Amino acid sequences of homologs and/or orthologs of the polypeptide having the amino acid sequence set forth in SEQ ID NO:624 are provided in FIG. 96. FIG. 96 also includes a consensus amino acid sequence determined by aligning homologous and/or orthologous amino acid sequences with the amino acid sequence set forth in SEQ ID NO:624.

For example, the alignment in FIG. 96 provides the amino acid sequences of Lead CeresClone 99075 (SEQ ID NO:624), gi|25518040 (SEQ ID NO:625), CeresClone:971321 (SEQ ID NO:626), CeresClone:516604 (SEQ ID NO:627), and CeresClone:1403244 (SEQ ID NO:628).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 625-628 or the consensus sequence set forth in FIG. 96.

A regulatory protein can have a so-called domain of unknown function. For example, a regulatory protein can have a DUF538, DUF599, or DUF647 domain. SEQ ID NO:298 sets forth the amino acid sequence of a DNA clone, identified herein as Ceres CLONE ID no. 272716 (SEQ ID NO:297), that is predicted to encode a polypeptide containing a DUF538 domain. SEQ ID NO:281 sets forth the amino acid sequence of a DNA clone, identified herein as Ceres CLONE ID no. 237356 (SEQ ID NO:280), that is predicted to encode a polypeptide containing a DUF599 domain. SEQ ID NO:97 sets forth the amino acid sequence of a DNA clone, identified herein as Ceres CDNA ID no. 2999012 (SEQ ID NO:96), that is predicted to encode a polypeptide containing a DUF647 domain.

A regulatory protein can comprise the amino acid sequence set forth in SEQ ID NO:298, SEQ ID NO:281, or SEQ ID NO:97. Alternatively, a regulatory protein can be a homolog, ortholog, or variant of the polypeptide having the amino acid sequence set forth in SEQ ID NO:298, SEQ ID NO:281, or SEQ ID NO:97. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:298, SEQ ID NO:281, or SEQ ID NO:97.

Figure 41:
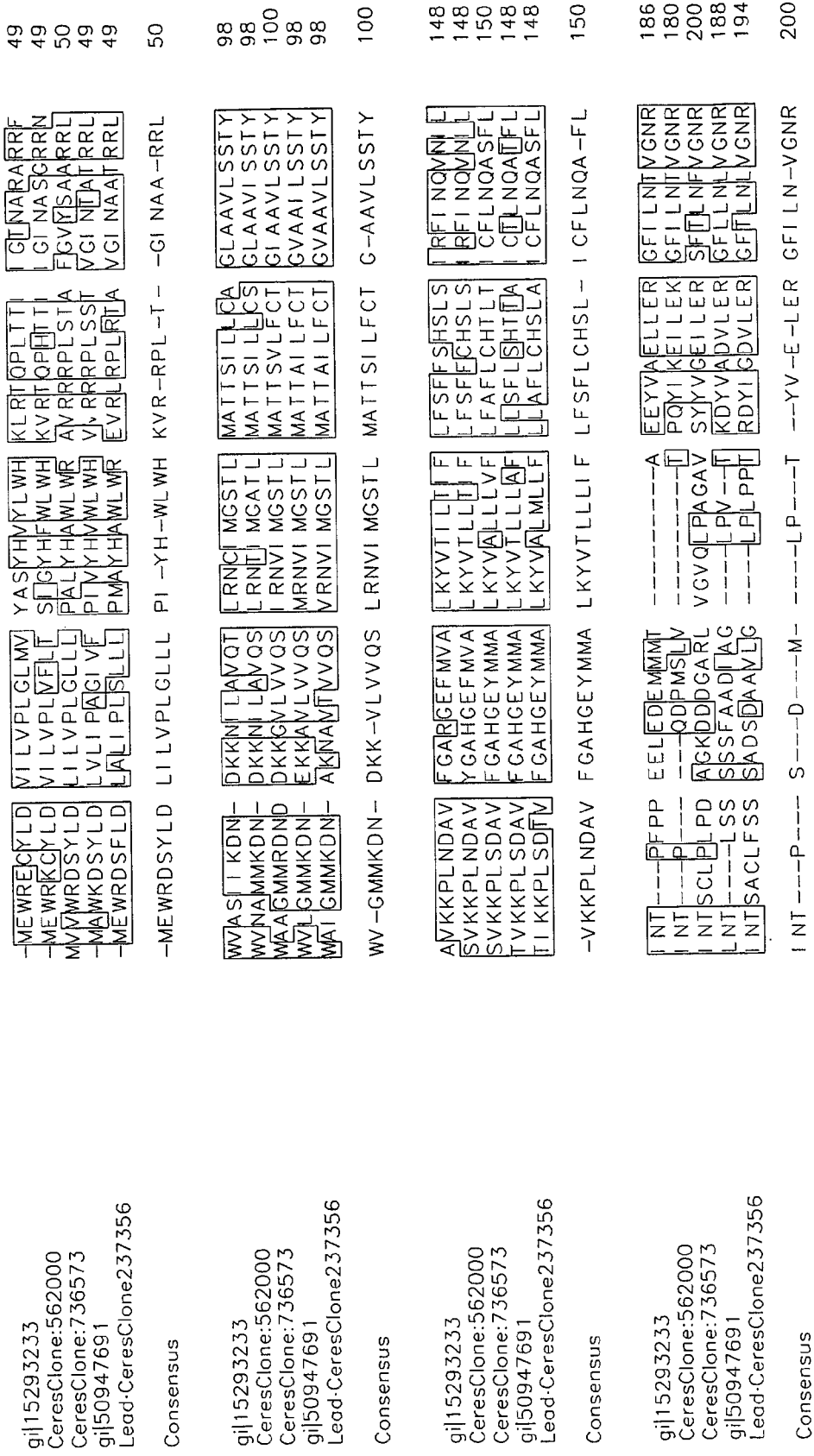
FIG. 41 is an alignment of the amino acid sequence of Lead CeresClone 237356 (SEQ ID NO:281) with homologous and/or orthologous amino acid sequences gi|15293233 (SEQ ID NO:282), CeresClone:562000 (SEQ ID NO:283), CeresClone:736573 (SEQ ID NO:284), and gi|50947691 (SEQ ID NO:285). The consensus sequence determined by the alignment is set forth.

Amino acid sequences of homologs and/or orthologs of the polypeptide having the amino acid sequence set forth in SEQ ID NO:298 and SEQ ID NO:281 are provided in FIG. 43 and FIG. 41. Each of FIG. 43 and FIG. 41 also includes a consensus amino acid sequence determined by aligning homologous and/or orthologous amino acid sequences with the amino acid sequence set forth in SEQ ID NO:298 and SEQ ID NO:281, respectively.

For example, the alignment in FIG. 43 provides the amino acid sequences of Lead CeresClone 272716 (SEQ ID NO:298), CeresClone:678281 (SEQ ID NO:299) and gi|54287657 (SEQ ID NO:300).

The alignment in FIG. 41 provides the amino acid sequences of Lead CeresClone 237356 (SEQ ID NO:281), gi|15293233 (SEQ ID NO:282), CeresClone:562000 (SEQ ID NO:283), CeresClone:736573 (SEQ ID NO:284), and gi|50947691 (SEQ ID NO:285).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 299-300, SEQ ID NOs:282-285, or the consensus sequence set forth in FIG. 43 or FIG. 41.

SEQ ID NO:956 sets forth the amino acid sequence of a DNA clone, identified herein as Ceres GDNA ANNOT ID no. 848446 (SEQ ID NO:955), that is predicted to encode a polypeptide that does not have homology to an existing protein family based on Pfam analysis. A regulatory protein can comprise the amino acid sequence set forth in SEQ ID NO:956. Alternatively, a regulatory protein can be a homolog, ortholog, or variant of the polypeptide having the amino acid sequence set forth in SEQ ID NO:956. For example, an oil-modulating polypeptide can have an amino acid sequence with at least 45% sequence identity, e.g., 45%, 50%, 55%, 60%, 65%, 70%, 75%, 80%, 85%, 90%, 95%, 97%, 98%, or 99% sequence identity, to the amino acid sequence set forth in SEQ ID NO:956.

A regulatory protein encoded by a recombinant nucleic acid can be a native regulatory protein, i.e., one or more additional copies of the coding sequence for a regulatory protein that is naturally present in the cell. Alternatively, a regulatory protein can be heterologous to the cell, e.g., a transgenic *Lycopersicon* plant can contain the coding sequence for a transcription factor polypeptide from an *Arabidopsis* plant.

A regulatory protein can include additional amino acids that are not involved in modulating gene expression, and thus can be longer than would otherwise be the case. For example, a regulatory protein can include an amino acid sequence that functions as a reporter. Such a regulatory protein can be a fusion protein in which a green fluorescent protein (GFP) polypeptide is fused to, e.g., SEQ ID NO:6, or in which a yellow fluorescent protein (YFP) polypeptide is fused to, e.g., SEQ ID NO:576. In some embodiments, a regulatory protein includes a purification tag, a chloroplast transit peptide, a mitochondrial transit peptide, or a leader sequence added to the amino or carboxyl terminus.

Regulatory protein candidates suitable for use in the invention can be identified by analysis of nucleotide and polypeptide sequence alignments. For example, performing a query on a database of nucleotide or polypeptide sequences can identify homologs and/or orthologs of regulatory proteins. Sequence analysis can involve BLAST, Reciprocal BLAST, or PSI-BLAST analysis of nonredundant databases using known regulatory protein amino acid sequences. Those polypeptides in the database that have greater than 40% sequence identity can be identified as candidates for further evaluation for suitability as regulatory proteins. Amino acid sequence similarity allows for conservative amino acid substitutions, such as substitution of one hydrophobic residue for another or substitution of one polar residue for another. If desired, manual inspection of such candidates can be carried out in order to narrow the number of candidates to be further evaluated. Manual inspection can be performed by selecting those candidates that appear to have domains suspected of being present in regulatory proteins, e.g., conserved functional domains.

The identification of conserved regions in a template or subject polypeptide can facilitate production of variants of regulatory proteins. Conserved regions can be identified by locating a region within the primary amino acid sequence of a template polypeptide that is a repeated sequence, forms some secondary structure (e.g., helices and beta sheets), establishes positively or negatively charged domains, or represents a protein motif or domain. See, e.g., the Pfam web site describing consensus sequences for a variety of protein motifs and domains at sanger.ac.uk/Pfam and genome.wustl.edu/Pfam. A description of the information included at the Pfam database is described in Sonnhammer et al., *Nucl. Acids Res.*, 26:320-322 (1998); Sonnhammer et al., *Proteins*, 28:405-420 (1997); and Bateman et al., *Nucl. Acids Res.*, 27:260-262 (1999).

Conserved regions also can be determined by aligning sequences of the same or related polypeptides from closely related species. Closely related species preferably are from the same family. In some embodiments, alignment of sequences from two different species is adequate. For example, sequences from *Arabidopsis* and *Zea mays* can be used to identify one or more conserved regions.

Typically, polypeptides that exhibit at least about 40% amino acid sequence identity are useful to identify conserved regions. Conserved regions of related polypeptides can exhibit at least 45% amino acid sequence identity, e.g., at least 50%, at least 60%, at least 70%, at least 80%, or at least 90% amino acid sequence identity. In some embodiments, a conserved region of target and template polypeptides exhibit at least 92%, 94%, 96%, 98%, or 99% amino acid sequence identity. Amino acid sequence identity can be deduced from amino acid or nucleotide sequences. In certain cases, highly conserved domains have been identified within regulatory proteins. These conserved regions can be useful in identifying functionally similar (orthologous) regulatory proteins.

In some instances, suitable regulatory proteins can be synthesized on the basis of consensus functional domains and/or conserved regions in polypeptides that are homologous regulatory proteins. Domains are groups of substantially contiguous amino acids in a polypeptide that can be used to characterize protein families and/or parts of proteins. Such domains have a "fingerprint" or "signature" that can comprise conserved (1) primary sequence, (2) secondary structure, and/or (3) three-dimensional conformation. Generally, domains are correlated with specific in vitro and/or in vivo activities. A domain can have a length of from 10 amino acids to 400 amino acids, e.g., 10 to 50 amino acids, or 25 to 100 amino acids, or 35 to 65 amino acids, or 35 to 55 amino acids, or 45 to 60 amino acids, or 200 to 300 amino acids, or 300 to 400 amino acids.

Figure 1:
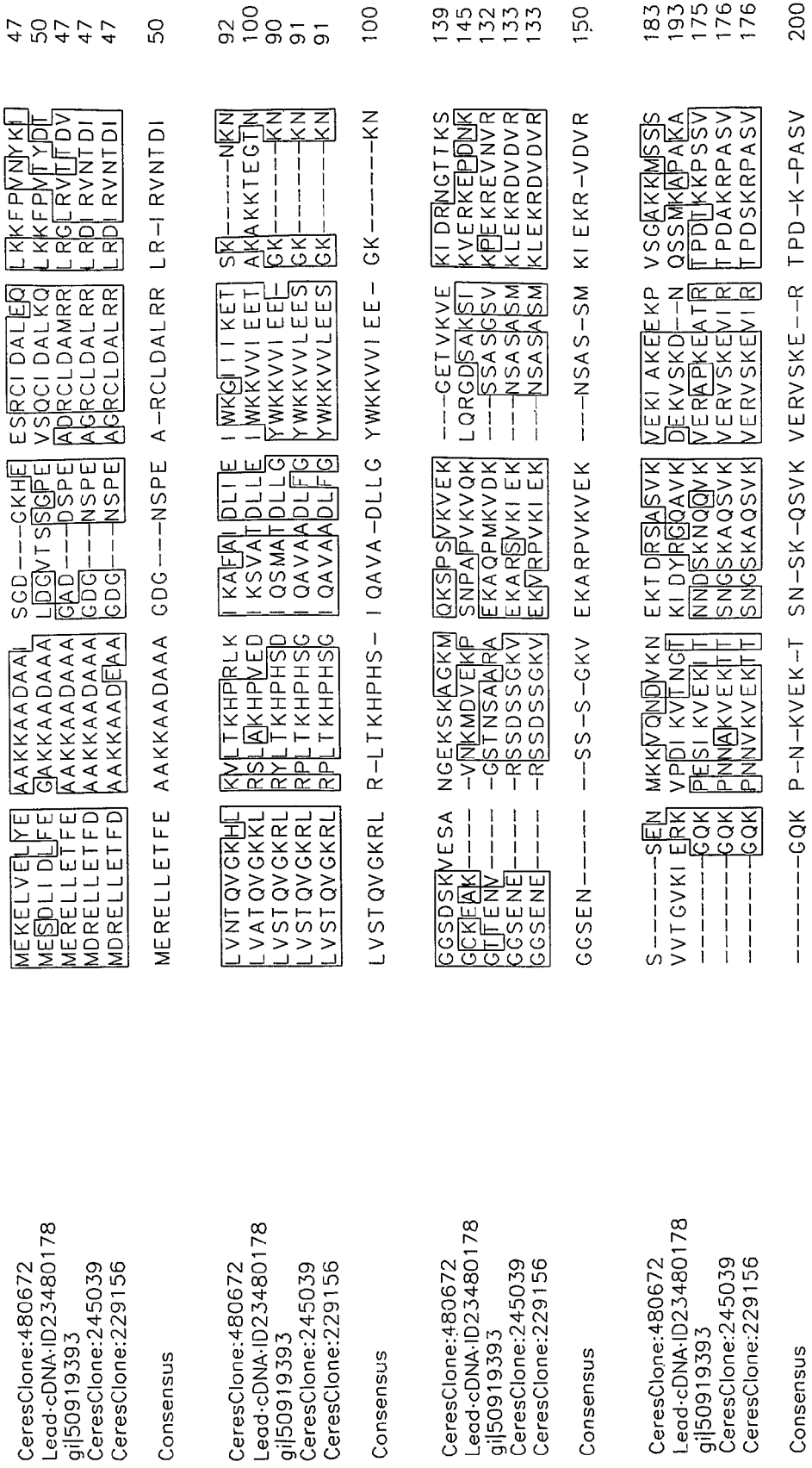
FIG. 1 is an alignment of the amino acid sequence of Lead CDNA ID 23480178 (SEQ ID NO:6) with homologous and/or orthologous amino acid sequences gi|50919393 (SEQ ID NO:7), CeresClone:480672 (SEQ ID NO:8), CeresClone:245039 (SEQ ID NO:9), and CeresClone:229156 (SEQ ID NO:10). The consensus sequence determined by the alignment is set forth.

Representative homologs and/or orthologs of regulatory proteins are shown in FIGS. 1-115. Each Figure represents an alignment of the amino acid sequence of a regulatory protein with the amino acid sequences of corresponding homologs and/or orthologs. Amino acid sequences of regulatory proteins and their corresponding homologs and/or orthologs have been aligned to identify conserved amino acids and to determine consensus sequences that contain frequently occurring amino acid residues at particular positions in the aligned sequences, as shown in FIGS. 1-115. A dash in an aligned sequence represents a gap, i.e., a lack of an amino acid at that position. Identical amino acids or conserved amino acid substitutions among aligned sequences are identified by boxes.

Each consensus sequence is comprised of conserved regions. Each conserved region contains a sequence of contiguous amino acid residues. A dash in a consensus sequence indicates that the consensus sequence either lacks an amino acid at that position or includes an amino acid at that position. If an amino acid is present, the residue at that position corresponds to one found in any aligned sequence at that position.

Useful polypeptides can be constructed based on the consensus sequence in any of FIGS. 1-115. Such a polypeptide includes the conserved regions in the selected consensus sequence, arranged in the order depicted in the Figure from amino-terminal end to carboxy-terminal end. Such a polypeptide may also include zero, one, or more than one amino acid in positions marked by dashes. When no amino acids are present at positions marked by dashes, the length of such a polypeptide is the sum of the amino acid residues in all conserved regions. When amino acids are present at all positions marked by dashes, such a polypeptide has a length that is the sum of the amino acid residues in all conserved regions and all dashes.

A conserved domain in certain cases may be 1) a localization domain, 2) an activation domain, 3) a repression domain, 4) an oligomerization domain or 5) a DNA binding domain. Consensus domains and conserved regions can be identified by homologous polypeptide sequence analysis as described above. The suitability of polypeptides for use as regulatory proteins can be evaluated by functional complementation studies.

A regulatory protein also can be a fragment of a naturally occurring regulatory protein. In certain cases, such as transcription factor regulatory proteins, a fragment can comprise the DNA-binding and transcription-regulating domains of the naturally occurring regulatory protein.

Additional information on regulatory protein domains is provided below.

DNA Binding Domain

A regulatory protein can include a domain, termed a DNA binding domain, which binds to a recognized site on DNA. A DNA binding domain of a regulatory protein can bind to one or more specific cis-responsive promoter motifs described herein. The typical result is modulation of transcription from a transcriptional start site associated with and operably linked to the cis-responsive motif. In some embodiments, binding of a DNA binding domain to a cis-responsive motif in planta involves other cellular components, which can be supplied by the plant.

Transactivation Domain

A regulatory protein can have discrete DNA binding and transactivation domains. Typically, transactivation domains bring proteins of the cellular transcription and translation machinery into contact with the transcription start site to initiate transcription. A transactivation domain of a regulatory protein can be synthetic or can be naturally-occurring. An example of a transactivation domain is the transactivation domain of a maize transcription factor C polypeptide.

Oligomerization Sequences

In some embodiments, a regulatory protein comprises oligomerization sequences. In some instances oligomerization is required for a ligand/regulatory protein complex or protein/protein complex to bind to a recognized DNA site. Oligomerization sequences can permit a regulatory protein to produce either homo- or heterodimers. Several motifs or domains in the amino acid sequence of a regulatory protein can influence heterodimerization or homodimerization of a given regulatory protein.

In some embodiments, transgenic plants also include a recombinant coactivator polypeptide that can interact with a regulatory protein to mediate the regulatory protein's effect on transcription of an endogenous gene. Such polypeptides include chaperoning. In some embodiments, a recombinant coactivator polypeptide is a chimera of a non-plant coactivator polypeptide and a plant coactivator polypeptide. Thus, in some embodiments, a regulatory protein described herein binds as a heterodimer to a promoter motif. In such embodiments, plants and plant cells contain a coding sequence for a second or other regulatory protein as a dimerization or multimerization partner, in addition to the coding sequence for the first regulatory protein.

Nucleic Acids

A nucleic acid can comprise a coding sequence that encodes any of the regulatory proteins as set forth in SEQ ID NO:2, SEQ ID NO:4, SEQ ID NOs:6-10, SEQ ID NO:12, SEQ ID NOs:14-17, SEQ ID NOs:19-20, SEQ ID NOs:22-25, SEQ ID NO:27, SEQ ID NOs:29-34, SEQ ID NOs:36-37, SEQ ID NO:39, SEQ ID NO:41, SEQ ID NO:43, SEQ ID NO:45, SEQ ID NOs:47-49, SEQ ID NO:51, SEQ ID NOs:53-56, SEQ ID NOs:58-64, SEQ ID NOs:66-67, SEQ ID NO:69, SEQ ID NO:71, SEQ ID NOs:73-74, SEQ ID NO:76, SEQ ID NO:78, SEQ ID NOs:80-82, SEQ ID NO:84, SEQ ID NO:86, SEQ ID NOs:88-90, SEQ ID NOs:92-95, SEQ ID NO:97, SEQ ID NOs:99-102, SEQ ID NO:104, SEQ ID NO:106, SEQ ID NOs:108-111, SEQ ID NO:113, SEQ ID NOs:115-117, SEQ ID NOs:119-122, SEQ ID NOs:124-127, SEQ ID NO:129, SEQ ID NOs:131-134, SEQ ID NOs:136-139, SEQ ID NOs:141-142, SEQ ID NOs:144-147, SEQ ID NO:149, SEQ ID NOs:151-152, SEQ ID NO:154, SEQ ID NO:156, SEQ ID NOs:158-161, SEQ ID NOs:163-169, SEQ ID NO:171, SEQ ID NOs:173-175, SEQ ID NOs:177-181, SEQ ID NOs:183-188, SEQ ID NO:190, SEQ ID NOs:192-198, SEQ ID NOs:200-204, SEQ ID NOs:206-208, SEQ ID NOs:210-216, SEQ ID NOs:218-220, SEQ ID NOs:222-227, SEQ ID NOs:229-243, SEQ ID NOs:245-247, SEQ ID NOs:249-251, SEQ ID NOs:253-264, SEQ ID NOs:266-273, SEQ ID NO:275, SEQ ID NOs:277-279, SEQ ID NOs:281-285, SEQ ID NO:287, SEQ ID NO:289, SEQ ID NOs:291-292, SEQ ID NO:294, SEQ ID NO:296, SEQ ID NOs:298-300, SEQ ID NOs:302-303, SEQ ID NOs:305-307, SEQ ID NOs:309-310, SEQ ID NOs:312-317, SEQ ID NOs:319-320, SEQ ID NO:322, SEQ ID NOs:324-326, SEQ ID NOs:328-329, SEQ ID NO:331, SEQ ID NO:333, SEQ ID NOs:335-339, SEQ ID NOs:341-342, SEQ ID NOs:344-347, SEQ ID NOs:349-353, SEQ ID NOs:355-357, SEQ ID NOs:359-361, SEQ ID NOs:363-366, SEQ ID NOs:368-372, SEQ ID NOs:374-382, SEQ ID NOs:384-389, SEQ ID NOs:391-392, SEQ ID NOs:394-395, SEQ ID NO:397, SEQ ID NOs:399-401, SEQ ID NO:403, SEQ ID NOs:405-406, SEQ ID NOs:408-410, SEQ ID NOs:412-414, SEQ ID NOs:416-422, SEQ ID NOs:424-425, SEQ ID NOs:427-430, SEQ ID NOs:432-434, SEQ ID NOs:436-442, SEQ ID NO:444, SEQ ID NOs:446-449, SEQ ID NO:451, SEQ ID NOs:453-463, SEQ ID NO:465, SEQ ID NOs:467-474, SEQ ID NOs:476-481, SEQ ID NOs:483-486, SEQ ID NOs:488-494, SEQ ID NOs:496-503, SEQ ID NOs:505-507, SEQ ID NOs:509-511, SEQ ID NOs:513-522, SEQ ID NOs:524-538, SEQ ID NOs:540-544, SEQ ID NO:546, SEQ ID NOs:548-552, SEQ ID NOs:554-555, SEQ ID NOs:557-564, SEQ ID NOs:566-574, SEQ ID NOs:576-578, SEQ ID NOs:580-583, SEQ ID NO:585, SEQ ID NO:587, SEQ ID NOs:589-591, SEQ ID NO:593, SEQ ID NO:595, SEQ ID NO:597, SEQ ID NOs:599-602, SEQ ID NOs:604-605, SEQ ID NOs:607-609, SEQ ID NO:611, SEQ ID NOs:613-614, SEQ ID NO:616, SEQ ID NOs:618-620, SEQ ID NO:622, SEQ ID NOs:624-628, SEQ ID NOs:630-634, SEQ ID NOs:636-638, SEQ ID NO:640, SEQ ID NOs:642-644, SEQ ID NOs:646-652, SEQ ID NO:654, SEQ ID NOs:656-658, SEQ ID NOs:660-661, SEQ ID NOs:663-664, SEQ ID NOs:666-669, SEQ ID NOs:671-672, SEQ ID NO:674, SEQ ID NOs:676-677, SEQ ID NO:679, SEQ ID NOs:681-682, SEQ ID NO:684, SEQ ID NO:686, SEQ ID NO:688, SEQ ID NOs:690-691, SEQ ID NOs:693-694, SEQ ID NOs:696-697, SEQ ID NO:699, SEQ ID NO:701, SEQ ID NO:703, SEQ ID NO:705, SEQ ID NOs:707-708, SEQ ID NO:710, SEQ ID NOs:712-722, SEQ ID NO:724, SEQ ID NO:726, SEQ ID NO:728, SEQ ID NOs:730-732, SEQ ID NOs:734-736, SEQ ID NO:738, SEQ ID NO:740, SEQ ID NO:742, SEQ ID NOs:744-746, SEQ ID NO:748, SEQ ID NO:750, SEQ ID NOs:752-754, SEQ ID NOs:756-757, SEQ ID NO:759, SEQ ID NOs:761-766, SEQ ID NO:768, SEQ ID NO:770, SEQ ID NOs:772-797, SEQ ID NO:799, SEQ ID NO:801, SEQ ID NO:803, SEQ ID NO:805, SEQ ID NO:807, SEQ ID NOs:809-813, SEQ ID NOs:815-818, SEQ ID NO:820, SEQ ID NO:822, SEQ ID NO:824, SEQ ID NO:826, SEQ ID NO:828, SEQ ID NO:830, SEQ ID NO:832, SEQ ID NO:834, SEQ ID NO:836, SEQ ID NO:838, SEQ ID NO:840, SEQ ID NOs:842-847, SEQ ID NOs:849-850, SEQ ID NOs:852-853, SEQ ID NO:855, SEQ ID NO:956, and the consensus sequences set forth in FIGS. 1-115. In some cases, a recombinant nucleic acid construct can include a nucleic acid comprising less than the full-length coding sequence of a regulatory protein. In some cases, a recombinant nucleic acid construct can include a nucleic acid comprising a coding sequence, a gene, or a fragment of a coding sequence or gene in an antisense orientation so that the antisense strand of RNA is transcribed.

It will be appreciated that a number of nucleic acids can encode a polypeptide having a particular amino acid sequence. The degeneracy of the genetic code is well known to the art; i.e., for many amino acids, there is more than one nucleotide triplet that serves as the codon for the amino acid. For example, codons in the coding sequence for a given regulatory protein can be modified such that optimal expression in a particular plant species is obtained, using appropriate codon bias tables for that species.

A nucleic acid also can comprise a nucleotide sequence corresponding to any of the regulatory regions as set forth in SEQ ID NOs:856-954. In some cases, a nucleic acid can comprise a nucleotide sequence corresponding to any of the regulatory regions as set forth in SEQ ID NOs:856-954 and a coding sequence that encodes any of the regulatory proteins as set forth in SEQ ID NO:2, SEQ ID NO:4, SEQ ID NOs:6-10, SEQ ID NO:12, SEQ ID NOs:14-17, SEQ ID NOs:19-20, SEQ ID NOs:22-25, SEQ ID NO:27, SEQ ID NOs:29-34, SEQ ID NOs:36-37, SEQ ID NO:39, SEQ ID NO:41, SEQ ID NO:43, SEQ ID NO:45, SEQ ID NOs:47-49, SEQ ID NO:51, SEQ ID NOs:53-56, SEQ ID NOs:58-64, SEQ ID NOs:66-67, SEQ ID NO:69, SEQ ID NO:71, SEQ ID NOs:73-74, SEQ ID NO:76, SEQ ID NO:78, SEQ ID NOs:80-82, SEQ ID NO:84, SEQ ID NO:86, SEQ ID NOs:88-90, SEQ ID NOs:92-95, SEQ ID NO:97, SEQ ID NOs:99-102, SEQ ID NO:104, SEQ ID NO:106, SEQ ID NOs:108-111, SEQ ID NO:113, SEQ ID NOs:115-117, SEQ ID NOs:119-122, SEQ ID NOs:124-127, SEQ ID NO:129, SEQ ID NOs:131-134, SEQ ID NOs:136-139, SEQ ID NOs:141-142, SEQ ID NOs:144-147, SEQ ID NO:149, SEQ ID NOs:151-152, SEQ ID NO:154, SEQ ID NO:156, SEQ ID NOs:158-161, SEQ ID NOs:163-169, SEQ ID NO:171, SEQ ID NOs:173-175, SEQ ID NOs:177-181, SEQ ID NOs:183-188, SEQ ID NO:190, SEQ ID NOs:192-198, SEQ ID NOs:200-204, SEQ ID NOs:206-208, SEQ ID NOs:210-216, SEQ ID NOs:218-220, SEQ ID NOs:222-227, SEQ ID NOs:229-243, SEQ ID NOs:245-247, SEQ ID NOs:249-251, SEQ ID NOs:253-264, SEQ ID NOs:266-273, SEQ ID NO:275, SEQ ID NOs:277-279, SEQ ID NOs:281-285, SEQ ID NO:287, SEQ ID NO:289, SEQ ID NOs:291-292, SEQ ID NO:294, SEQ ID NO:296, SEQ ID NOs:298-300, SEQ ID NOs:302-303, SEQ ID NOs:305-307, SEQ ID NOs:309-310, SEQ ID NOs:312-317, SEQ ID NOs:319-320, SEQ ID NO:322, SEQ ID NOs:324-326, SEQ ID NOs:328-329, SEQ ID NO:331, SEQ ID NO:333, SEQ ID NOs:335-339, SEQ ID NOs:341-342, SEQ ID NOs:344-347, SEQ ID NOs:349-353, SEQ ID NOs:355-357, SEQ ID NOs:359-361, SEQ ID NOs:363-366, SEQ ID NOs:368-372, SEQ ID NOs:374-382, SEQ ID NOs:384-389, SEQ ID NOs:391-392, SEQ ID NOs:394-395, SEQ ID NO:397, SEQ ID NOs:

399-401, SEQ ID NO:403, SEQ ID NOs:405-406, SEQ ID NOs:408-410, SEQ ID NOs:412-414, SEQ ID NOs:416-422, SEQ ID NOs:424-425, SEQ ID NOs:427-430, SEQ ID NOs: 432-434, SEQ ID NOs:436-442, SEQ ID NO:444, SEQ ID NOs:446-449, SEQ ID NO:451, SEQ ID NOs:453-463, SEQ ID NO:465, SEQ ID NOs:467-474, SEQ ID NOs:476-481, SEQ ID NOs:483-486, SEQ ID NOs:488-494, SEQ ID NOs: 496-503, SEQ ID NOs:505-507, SEQ ID NOs:509-511, SEQ ID NOs:513-522, SEQ ID NOs:524-538, SEQ ID NOs:540-544, SEQ ID NO:546, SEQ ID NOs:548-552, SEQ ID NOs: 554-555, SEQ ID NOs:557-564, SEQ ID NOs:566-574, SEQ ID NOs:576-578, SEQ ID NOs:580-583, SEQ ID NO:585, SEQ ID NO:587, SEQ ID NOs:589-591, SEQ ID NO:593, SEQ ID NO:595, SEQ ID NO:597, SEQ ID NOs:599-602, SEQ ID NOs:604-605, SEQ ID NOs:607-609, SEQ ID NO:611, SEQ ID NOs:613-614, SEQ ID NO:616, SEQ ID NOs:618-620, SEQ ID NO:622, SEQ ID NOs:624-628, SEQ ID NOs:630-634, SEQ ID NOs:636-638, SEQ ID NO:640, SEQ ID NOs:642-644, SEQ ID NOs:646-652, SEQ ID NO:654, SEQ ID NOs:656-658, SEQ ID NOs:660-661, SEQ ID NOs:663-664, SEQ ID NOs:666-669, SEQ ID NOs:671-672, SEQ ID NO:674, SEQ ID NOs:676-677, SEQ ID NO:679, SEQ ID NOs:681-682, SEQ ID NO:684, SEQ ID NO:686, SEQ ID NO:688, SEQ ID NOs:690-691, SEQ ID NOs:693-694, SEQ ID NOs:696-697, SEQ ID NO:699, SEQ ID NO:701, SEQ ID NO:703, SEQ ID NO:705, SEQ ID NOs:707-708, SEQ ID NO:710, SEQ ID NOs:712-722, SEQ ID NO:724, SEQ ID NO:726, SEQ ID NO:728, SEQ ID NOs:730-732, SEQ ID NOs:734-736, SEQ ID NO:738, SEQ ID NO:740, SEQ ID NO:742, SEQ ID NOs:744-746, SEQ ID NO:748, SEQ ID NO:750, SEQ ID NOs:752-754, SEQ ID NOs:756-757, SEQ ID NO:759, SEQ ID NOs:761-766, SEQ ID NO:768, SEQ ID NO:770, SEQ ID NOs:772-797, SEQ ID NO:799, SEQ ID NO:801, SEQ ID NO:803, SEQ ID NO:805, SEQ ID NO:807, SEQ ID NOs:809-813, SEQ ID NOs:815-818, SEQ ID NO:820, SEQ ID NO:822, SEQ ID NO:824, SEQ ID NO:826, SEQ ID NO:828, SEQ ID NO:830, SEQ ID NO:832, SEQ ID NO:834, SEQ ID NO:836, SEQ ID NO:838, SEQ ID NO:840, SEQ ID NOs: 842-847, SEQ ID NOs:849-850, SEQ ID NOs:852-853, SEQ ID NO:855, SEQ ID NO:956, or a consensus sequence set forth in any of FIGS. 1-115.

The terms "nucleic acid" and "polynucleotide" are used interchangeably herein, and refer both to RNA and DNA, including cDNA, genomic DNA, synthetic DNA, and DNA (or RNA) containing nucleic acid analogs. Polynucleotides can have any three-dimensional structure. A nucleic acid can be double-stranded or single-stranded (i.e., a sense strand or an antisense strand). Non-limiting examples of polynucleotides include genes, gene fragments, exons, introns, messenger RNA (mRNA), transfer RNA, ribosomal RNA, siRNA, micro-RNA, ribozymes, cDNA, recombinant polynucleotides, branched polynucleotides, plasmids, vectors, isolated DNA of any sequence, isolated RNA of any sequence, nucleic acid probes, and primers, as well as nucleic acid analogs.

An isolated nucleic acid can be, for example, a naturally-occurring DNA molecule, provided one of the nucleic acid sequences normally found immediately flanking that DNA molecule in a naturally-occurring genome is removed or absent. Thus, an isolated nucleic acid includes, without limitation, a DNA molecule that exists as a separate molecule, independent of other sequences (e.g., a chemically synthesized nucleic acid, or a cDNA or genomic DNA fragment produced by the polymerase chain reaction (PCR) or restriction endonuclease treatment). An isolated nucleic acid also refers to a DNA molecule that is incorporated into a vector, an autonomously replicating plasmid, a virus, or into the genomic DNA of a prokaryote or eukaryote. In addition, an isolated nucleic acid can include an engineered nucleic acid such as a DNA molecule that is part of a hybrid or fusion nucleic acid. A nucleic acid existing among hundreds to millions of other nucleic acids within, for example, cDNA libraries or genomic libraries, or gel slices containing a genomic DNA restriction digest, is not to be considered an isolated nucleic acid.

Isolated nucleic acid molecules can be produced by standard techniques. For example, polymerase chain reaction (PCR) techniques can be used to obtain an isolated nucleic acid containing a nucleotide sequence described herein. PCR can be used to amplify specific sequences from DNA as well as RNA, including sequences from total genomic DNA or total cellular RNA. Various PCR methods are described, for example, in *PCR Primer: A Laboratory Manual*, Dieffenbach and Dveksler, eds., Cold Spring Harbor Laboratory Press, 1995. Generally, sequence information from the ends of the region of interest or beyond is employed to design oligonucleotide primers that are identical or similar in sequence to opposite strands of the template to be amplified. Various PCR strategies also are available by which site-specific nucleotide sequence modifications can be introduced into a template nucleic acid. Isolated nucleic acids also can be chemically synthesized, either as a single nucleic acid molecule (e.g., using automated DNA synthesis in the 3' to 5' direction using phosphoramidite technology) or as a series of oligonucleotides. For example, one or more pairs of long oligonucleotides (e.g., >100 nucleotides) can be synthesized that contain the desired sequence, with each pair containing a short segment of complementarity (e.g., about 15 nucleotides) such that a duplex is formed when the oligonucleotide pair is annealed. DNA polymerase is used to extend the oligonucleotides, resulting in a single, double-stranded nucleic acid molecule per oligonucleotide pair, which then can be ligated into a vector. Isolated nucleic acids of the invention also can be obtained by mutagenesis of, e.g., a naturally occurring DNA.

As used herein, the term "percent sequence identity" refers to the degree of identity between any given query sequence and a subject sequence. A subject sequence typically has a length that is more than 80%, e.g., more than 82%, 85%, 87%, 89%, 90%, 93%, 95%, 97%, 99%, 100%, 105%, 110%, 115%, or 120%, of the length of the query sequence. A query nucleic acid or amino acid sequence is aligned to one or more subject nucleic acid or amino acid sequences using the computer program ClustalW (version 1.83, default parameters), which allows alignments of nucleic acid or protein sequences to be carried out across their entire length (global alignment). Chenna et al., *Nucleic Acids Res.,* 31(13):3497-500 (2003).

ClustalW calculates the best match between a query and one or more subject sequences, and aligns them so that identities, similarities and differences can be determined. Gaps of one or more residues can be inserted into a query sequence, a subject sequence, or both, to maximize sequence alignments. For fast pairwise alignment of nucleic acid sequences, the following default parameters are used: word size: 2; window size: 4; scoring method: percentage; number of top diagonals: 4; and gap penalty: 5. For multiple alignment of nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: percentage; number of top diagonals: 5; gap penalty: 3. For multiple alignment of protein sequences, the following parameters are used: weight matrix: blosum; gap opening penalty: 10.0; gap extension penalty: 0.05;

hydrophilic gaps: on; hydrophilic residues: Gly, Pro, Ser, Asn, Asp, Gln, Glu, Arg, and Lys; residue-specific gap penalties: on. The output is a sequence alignment that reflects the relationship between sequences. ClustalW can be run, for example, at the Baylor College of Medicine Search Launcher site (searchlauncher.bcm.tmc.edu/multi-align/multi-align.html) and at the European Bioinformatics Institute site on the World Wide Web (ebi.ac.uk/clustalw).

To determine a percent identity between a query sequence and a subject sequence, ClustalW divides the number of identities in the best alignment by the number of residues compared (gap positions are excluded), and multiplies the result by 100. The output is the percent identity of the subject sequence with respect to the query sequence. It is noted that the percent identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

The term "exogenous" with respect to a nucleic acid indicates that the nucleic acid is part of a recombinant nucleic acid construct, or is not in its natural environment. For example, an exogenous nucleic acid can be a sequence from one species introduced into another species, i.e., a heterologous nucleic acid. Typically, such an exogenous nucleic acid is introduced into the other species via a recombinant nucleic acid construct. An exogenous nucleic acid can also be a sequence that is native to an organism and that has been reintroduced into cells of that organism. An exogenous nucleic acid that includes a native sequence can often be distinguished from the naturally occurring sequence by the presence of non-natural sequences linked to the exogenous nucleic acid, e.g., non-native regulatory sequences flanking a native sequence in a recombinant nucleic acid construct. In addition, stably transformed exogenous nucleic acids typically are integrated at positions other than the position where the native sequence is found. It will be appreciated that an exogenous nucleic acid may have been introduced into a progenitor and not into the cell under consideration. For example, a transgenic plant containing an exogenous nucleic acid can be the progeny of a cross between a stably transformed plant and a non-transgenic plant. Such progeny are considered to contain the exogenous nucleic acid.

Similarly, a regulatory protein can be endogenous or exogenous to a particular plant or plant cell. Exogenous regulatory proteins, therefore, can include proteins that are native to a plant or plant cell, but that are expressed in a plant cell via a recombinant nucleic acid construct, e.g., a *Lycopersicon* plant transformed with a recombinant nucleic acid construct encoding a *Lycopersicon* transcription factor.

Likewise, a regulatory region can be exogenous or endogenous to a plant or plant cell. An exogenous regulatory region is a regulatory region that is part of a recombinant nucleic acid construct, or is not in its natural environment. For example, a *Nicotiana* promoter present on a recombinant nucleic acid construct is an exogenous regulatory region when a *Nicotiana* plant cell is transformed with the construct.

A transgenic plant or plant cell in which the amount and/or rate of biosynthesis of one or more sequences of interest is modulated includes at least one recombinant nucleic acid construct, e.g., a nucleic acid construct comprising a nucleic acid encoding a regulatory protein or a nucleic acid construct comprising a regulatory region as described herein. In certain cases, more than one recombinant nucleic acid construct can be included (e.g., two, three, four, five, six, or more recombinant nucleic acid constructs). For example, two recombinant nucleic acid constructs can be included, where one construct includes a nucleic acid encoding one regulatory protein, and another construct includes a nucleic acid encoding a second regulatory protein. In some cases, one construct can include a nucleic acid encoding one regulatory protein, while another includes a regulatory region. In other cases, a plant cell can include a recombinant nucleic acid construct comprising a nucleic acid encoding a regulatory protein and further comprising a regulatory region that associates with the regulatory protein. In such cases, additional recombinant nucleic acid constructs can also be included in the plant cell, e.g., containing additional regulatory proteins and/or regulatory regions.

Vectors containing nucleic acids such as those described herein also are provided. A "vector" is a replicon, such as a plasmid, phage, or cosmid, into which another DNA segment may be inserted so as to bring about the replication of the inserted segment. Generally, a vector is capable of replication when associated with the proper control elements. Suitable vector backbones include, for example, those routinely used in the art such as plasmids, viruses, artificial chromosomes, BACs, YACs, or PACs. The term "vector" includes cloning and expression vectors, as well as viral vectors and integrating vectors. An "expression vector" is a vector that includes a regulatory region. Suitable expression vectors include, without limitation, plasmids and viral vectors derived from, for example, bacteriophage, baculoviruses, and retroviruses. Numerous vectors and expression systems are commercially available from such corporations as Novagen (Madison, Wis.), Clontech (Mountain View, Calif.), Stratagene (La Jolla, Calif.), and Invitrogen/Life Technologies (Carlsbad, Calif.).

The vectors provided herein also can include, for example, origins of replication, scaffold attachment regions (SARs), and/or markers. A marker gene can confer a selectable phenotype on a plant cell. For example, a marker can confer biocide resistance, such as resistance to an antibiotic (e.g., kanamycin, G418, bleomycin, or hygromycin), or an herbicide (e.g., chlorosulfuron or phosphinothricin). In addition, an expression vector can include a tag sequence designed to facilitate manipulation or detection (e.g., purification or localization) of the expressed polypeptide. Tag sequences, such as green fluorescent protein (GFP), glutathione S-transferase (GST), polyhistidine, c-myc, hemagglutinin, or Flag™ tag (Kodak, New Haven, Conn.) sequences typically are expressed as a fusion with the encoded polypeptide. Such tags can be inserted anywhere within the polypeptide, including at either the carboxyl or amino terminus.

As described herein, plant cells can be transformed with a recombinant nucleic acid construct to express a polypeptide of interest. The polypeptide can then be extracted and purified using techniques known to those having ordinary skill in the art.

Regulatory Regions

Particular regulatory regions were examined for their ability to associate with regulatory proteins described herein. The sequences of these regulatory regions are set forth in SEQ ID NOs:856-870. These regulatory regions were initially chosen for investigation because they were thought to be regulatory regions involved in terpenoid biosynthetic pathways in *Arabidopsis thaliana*. Using the methods described herein, regulatory proteins that can associate with some of these regulatory regions were identified, and such associations are listed in Table 4 (under Example 5). In turn, knowledge of a regulatory protein-regulatory region association facilitates the modulation of expression of sequences of interest that are operably linked to a given regulatory region by the associated regulatory protein. The regulatory protein associated with the regulatory region operably linked to the sequence of interest is itself operably linked to a regulatory region. The amount and specificity of expression of a regulatory protein can be modulated by selecting an appropriate regulatory region to direct expression of the regulatory protein. For example, a regulatory protein can be broadly expressed under the direction of a promoter such as a CaMV 35S promoter. Once expressed, the regulatory protein can directly or indirectly affect expression of a sequence of interest operably linked to another regulatory region, which is associated with the regulatory protein. In some cases, a regulatory protein can be expressed under the direction of a cell type- or tissue-preferential promoter, such as a cell type- or tissue-preferential promoter described below. In some embodiments, a regulatory region useful in the methods described herein has 80% or greater, e.g., 85%, 90%, 95%, 97%, 98%, 99%, or 100%, sequence identity to a regulatory region set forth in SEQ ID NOs:856-870.

The methods described herein can also be used to identify new regulatory region-regulatory protein association pairs. For example, an ortholog to a given regulatory protein is expected to associate with the associated regulatory region for that regulatory protein.

It should be noted that for a given regulatory protein listed in Table 4 (under Example 5), a regulatory region construct that includes one or more regulatory regions is set forth. A regulatory protein is expected to associate with either one or both such regulatory regions. Similarly, FIGS. 1-115 provide ortholog/homolog sequences and consensus sequences for corresponding regulatory proteins. It is contemplated that each such ortholog/homolog sequence and each polypeptide sequence that corresponds to the consensus sequence of the regulatory protein would also associate with the regulatory regions associated with the given regulatory protein as set forth in Table 4 (under Example 5).

The term "regulatory region" refers to nucleotide sequences that influence transcription or translation initiation and rate, and stability and/or mobility of a transcription or translation product. Regulatory regions include, without limitation, promoter sequences, enhancer sequences, response elements, protein recognition sites, inducible elements, protein binding sequences, 5' and 3' untranslated regions (UTRs), transcriptional start sites, termination sequences, polyadenylation sequences, and introns.

As used herein, the term "operably linked" refers to positioning of a regulatory region and a sequence to be transcribed in a nucleic acid so as to influence transcription or translation of such a sequence. For example, to bring a coding sequence under the control of a promoter, the translation initiation site of the translational reading frame of the polypeptide is typically positioned between one and about fifty nucleotides downstream of the promoter. A promoter can, however, be positioned as much as about 5,000 nucleotides upstream of the translation initiation site, or about 2,000 nucleotides upstream of the transcription start site. A promoter typically comprises at least a core (basal) promoter. A promoter also may include at least one control element, such as an enhancer sequence, an upstream element or an upstream activation region (UAR). For example, a suitable enhancer is a cis-regulatory element (−212 to −154) from the upstream region of the octopine synthase (ocs) gene. Fromm et al., *The Plant Cell*, 1:977-984 (1989). The choice of promoters to be included depends upon several factors, including, but not limited to, efficiency, selectability, inducibility, desired expression level, and cell- or tissue-preferential expression. It is a routine matter for one of skill in the art to modulate the expression of a coding sequence by appropriately selecting and positioning promoters and other regulatory regions relative to the coding sequence.

Some suitable promoters initiate transcription only, or predominantly, in certain cell types. For example, a promoter that is active predominantly in a reproductive tissue (e.g., fruit, ovule, pollen, pistils, female gametophyte, egg cell, central cell, nucellus, suspensor, synergid cell, inflorescence, embryonic tissue, embryo sac, embryo, zygote, endosperm, integument, or seed coat) can be used. Thus, as used herein a cell type- or tissue-preferential promoter is one that drives expression preferentially in the target tissue, but may also lead to some expression in other cell types or tissues as well. Methods for identifying and characterizing promoter regions in plant genomic DNA include, for example, those described in the following references: Jordano et al., *Plant Cell*, 1:855-866 (1989); Bustos et al., *Plant Cell*, 1:839-854 (1989); Green et al., *EMBO J.*, 7:4035-4044 (1988); Meier et al., *Plant Cell*, 3:309-316 (1991); and Zhang et al., *Plant Physiology*, 110: 1069-1079 (1996).

Examples of various classes of promoters are described below. Some of the promoters indicated below as well as additional promoters are described in more detail in U.S. patent application Ser. Nos. 60/505,689; 60/518,075; 60/544,771; 60/558,869; 60/583,691; 60/619,181; 60/637,140; 60/757,544; 60/776,307; 10/957,569; 11/058,689; 11/172,703; 11/208,308; 11/274,890; 60/583,609; 60/612,891; 11/097,589; 11/233,726; 10/950,321; PCT/US05/011105; PCT/US05/034308; and PCT/US05/23639. Nucleotide sequences of promoters are set forth in SEQ ID NOs:871-954. It will be appreciated that a promoter may meet criteria for one classification based on its activity in one plant species, and yet meet criteria for a different classification based on its activity in another plant species.

Broadly Expressing Promoters

A promoter can be said to be "broadly expressing" when it promotes transcription in many, but not necessarily all, plant tissues. For example, a broadly expressing promoter can promote transcription of an operably linked sequence in one or more of the shoot, shoot tip (apex), and leaves, but weakly or not at all in tissues such as roots or stems. As another example, a broadly expressing promoter can promote transcription of an operably linked sequence in one or more of the stem, shoot, shoot tip (apex), and leaves, but can promote transcription weakly or not at all in tissues such as reproductive tissues of flowers and developing seeds. Non-limiting examples of broadly expressing promoters that can be included in the nucleic acid constructs provided herein include the p326 (SEQ ID NO:951), YP0144 (SEQ ID NO:930), YP0190 (SEQ ID NO:934), p13879 (SEQ ID NO:950), YP0050 (SEQ ID NO:910), p32449 (SEQ ID NO:952), 21876 (SEQ ID NO:877), YP0158 (SEQ ID NO:932), YP0214 (SEQ ID NO:936), YP0380 (SEQ ID NO:945), PT0848 (SEQ ID NO:902), and PT0633 (SEQ ID NO:883) promoters. Additional examples include the cauliflower mosaic virus (CaMV) 35S promoter, the mannopine synthase (MAS) promoter, the 1' or 2' promoters derived from T-DNA of *Agrobacterium tumefaciens*, the figwort mosaic virus 34S promoter, actin promoters such as the rice actin promoter, and ubiquitin promoters such as the maize ubiquitin-1 promoter. In some cases, the CaMV 35S promoter is excluded from the category of broadly expressing promoters.

Root Promoters

Root-active promoters confer transcription in root tissue, e.g., root endodermis, root epidermis, or root vascular tissues. In some embodiments, root-active promoters are root-preferential promoters, i.e., confer transcription only or predominantly in root tissue. Root-preferential promoters include the YP0128 (SEQ ID NO:927), YP0275 (SEQ ID NO:938), PT0625 (SEQ ID NO:882), PT0660 (SEQ ID NO:885), PT0683 (SEQ ID NO:890), and PT0758 (SEQ ID NO:898) promoters. Other root-preferential promoters include the PT0613 (SEQ ID NO:881), PT0672 (SEQ ID NO:887), PT0688 (SEQ ID NO:891), and PT0837 (SEQ ID NO:900) promoters, which drive transcription primarily in root tissue and to a lesser extent in ovules and/or seeds. Other examples of root-preferential promoters include the root-specific subdomains of the CaMV 35S promoter (Lam et al., *Proc. Natl. Acad. Sci. USA*, 86:7890-7894 (1989)), root cell specific promoters reported by Conkling et al., *Plant Physiol.*, 93:1203-1211 (1990), and the tobacco RD2 promoter.

Maturing Endosperm Promoters

In some embodiments, promoters that drive transcription in maturing endosperm can be useful. Transcription from a maturing endosperm promoter typically begins after fertilization and occurs primarily in endosperm tissue during seed development and is typically highest during the cellularization phase. Most suitable are promoters that are active predominantly in maturing endosperm, although promoters that are also active in other tissues can sometimes be used. Non-limiting examples of maturing endosperm promoters that can be included in the nucleic acid constructs provided herein include the napin promoter, the Arcelin-5 promoter, the phaseolin promoter (Bustos et al., *Plant Cell*, 1(9):839-853 (1989)), the soybean trypsin inhibitor promoter (Riggs et al., *Plant Cell*, 1(6):609-621 (1989)), the ACP promoter (Baerson et al., *Plant Mol. Biol.*, 22(2):255-267 (1993)), the stearoyl-ACP desaturase promoter (Slocombe et al., *Plant Physiol.*, 104(4):167-176 (1994)), the soybean α' subunit of β-conglycinin promoter (Chen et al., *Proc. Natl. Acad. Sci. USA*, 83:8560-8564 (1986)), the oleosin promoter (Hong et al., *Plant Mol. Biol.*, 34(3):549-555 (1997)), and zein promoters, such as the 15 kD zein promoter, the 16 kD zein promoter, 19 kD zein promoter, 22 kD zein promoter and 27 kD zein promoter. Also suitable are the Osgt-1 promoter from the rice glutelin-1 gene (Zheng et al., *Mol. Cell. Biol.*, 13:5829-5842 (1993)), the beta-amylase promoter, and the barley hordein promoter. Other maturing endosperm promoters include the YP0092 (SEQ ID NO:913), PT0676 (SEQ ID NO:888), and PT0708 (SEQ ID NO:893) promoters.

Ovary Tissue Promoters

Promoters that are active in ovary tissues such as the ovule wall and mesocarp can also be useful, e.g., a polygalacturonidase promoter, the banana TRX promoter, and the melon actin promoter. Examples of promoters that are active primarily in ovules include YP0007 (SEQ ID NO:906), YP0111 (SEQ ID NO:921), YP0092 (SEQ ID NO:913), YP0103 (SEQ ID NO:918), YP0028 (SEQ ID NO:908), YP0121 (SEQ ID NO:926), YP0008 (SEQ ID NO:907), YP0039 (SEQ ID NO:909), YP0115 (SEQ ID NO:922), YP0119 (SEQ ID NO:924), YP0120 (SEQ ID NO:925), and YP0374 (SEQ ID NO:943).

Embryo Sac/Early Endosperm Promoters

To achieve expression in embryo sac/early endosperm, regulatory regions can be used that are active in polar nuclei and/or the central cell, or in precursors to polar nuclei, but not in egg cells or precursors to egg cells. Most suitable are promoters that drive expression only or predominantly in polar nuclei or precursors thereto and/or the central cell. A pattern of transcription that extends from polar nuclei into early endosperm development can also be found with embryo sac/early endosperm-preferential promoters, although transcription typically decreases significantly in later endosperm development during and after the cellularization phase. Expression in the zygote or developing embryo typically is not present with embryo sac/early endosperm promoters.

Promoters that may be suitable include those derived from the following genes: *Arabidopsis* viviparous-1 (see, GenBank No. U93215); *Arabidopsis* atmyc1 (see, Urao (1996) *Plant Mol. Biol.*, 32:571-57; Conceicao (1994) *Plant*, 5:493-505); *Arabidopsis* FIE (GenBank No. AF129516); *Arabidopsis* MEA; *Arabidopsis* FIS2 (GenBank No. AF096096); and FIE 1.1 (U.S. Pat. No. 6,906,244). Other promoters that may be suitable include those derived from the following genes: maize MAC1 (see, Sheridan (1996) *Genetics*, 142:1009-1020); maize Cat3 (see, GenBank No. L05934; Abler (1993) *Plant Mol. Biol.*, 22:10131-1038). Other promoters include the following *Arabidopsis* promoters: YP0039 (SEQ ID NO:909), YP0101 (SEQ ID NO:916), YP0102 (SEQ ID NO:917), YP010 (SEQ ID NO:920), YP0117 (SEQ ID NO:923), YP0119 (SEQ ID NO:924), YP0137 (SEQ ID NO:928), DME, YP0285 (SEQ ID NO:939), and YP0212 (SEQ ID NO:935). Other promoters that may be useful include the following rice promoters: p530c10, pOsFIE2-2, pOsMEA, pOsYp102, and pOsYp285.

Embryo Promoters

Regulatory regions that preferentially drive transcription in zygotic cells following fertilization can provide embryo-preferential expression. Most suitable are promoters that preferentially drive transcription in early stage embryos prior to the heart stage, but expression in late stage and maturing embryos is also suitable. Embryo-preferential promoters include the barley lipid transfer protein (Ltp1) promoter (*Plant Cell Rep* (2001) 20:647-654), YP0097 (SEQ ID NO:915), YP0107 (SEQ ID NO:919), YP0088 (SEQ ID NO:912), YP0143 (SEQ ID NO:929), YP0156 (SEQ ID NO:931), PT0650 (SEQ ID NO:884), PT0695 (SEQ ID NO:892), PT0723 (SEQ ID NO:895), PT0838 (SEQ ID NO:901), PT0879 (SEQ ID NO:904), and PT0740 (SEQ ID NO:896).

Photosynthetic Tissue Promoters

Promoters active in photosynthetic tissue confer transcription in green tissues such as leaves and stems. Most suitable are promoters that drive expression only or predominantly in such tissues. Examples of such promoters include the ribulose-1,5-bisphosphate carboxylase (RbcS) promoters such as the RbcS promoter from eastern larch (*Larix laricina*), the pine cab6 promoter (Yamamoto et al., *Plant Cell Physiol.*, 35:773-778 (1994)), the Cab-1 promoter from wheat (Fejes et al., *Plant Mol. Biol.*, 15:921-932 (1990)), the CAB-1 promoter from spinach (Lubberstedt et al., *Plant Physiol.*, 104:997-1006 (1994)), the cab1R promoter from rice (Luan et al., *Plant Cell*, 4:971-981 (1992)), the pyruvate orthophosphate dikinase (PPDK) promoter from corn (Matsuoka et al., *Proc. Natl. Acad. Sci. USA*, 90:9586-9590 (1993)), the tobacco Lhcb1*2 promoter (Cerdan et al., *Plant Mol. Biol.*, 33:245-255 (1997)), the *Arabidopsis thaliana* SUC2 sucrose-H+ symporter promoter (Truernit et al., *Planta*, 196:564-570 (1995)), and thylakoid membrane protein promoters from spinach (psaD, psaF, psaE, PC, FNR, atpC, atpD, cab, rbcS). Other photosynthetic tissue promoters include PT0535 (SEQ ID NO:879), PT0668 (SEQ ID NO:878), PT0886 (SEQ ID NO:905), YP0144 (SEQ ID NO:930), YP0380 (SEQ ID NO:945), and PT0585 (SEQ ID NO:880).

Vascular Tissue Promoters

Examples of promoters that have high or preferential activity in vascular bundles include YP0087, YP0093, YP0108, YP0022, and YP0080. Other vascular tissue-preferential promoters include the glycine-rich cell wall protein GRP 1.8 promoter (Keller and Baumgartner, *Plant Cell*, 3(10):1051-1061 (1991)), the Commelina yellow mottle virus (CoYMV) promoter (Medberry et al., *Plant Cell*, 4(2):185-192 (1992)), and the rice tungro bacilliform virus (RTBV) promoter (Dai et al., *Proc. Natl. Acad. Sci. USA,* 101(2):687-692 (2004)). Promoters having preferential activity in sieve, laticifer, and/or companion cells are also considered vascular tissue promoters.

Inducible Promoters

Inducible promoters confer transcription in response to external stimuli such as chemical agents or environmental stimuli. For example, inducible promoters can confer transcription in response to hormones such as giberellic acid or ethylene, or in response to light or drought. Examples of drought-inducible promoters include YP0380 (SEQ ID NO:945), PT0848 (SEQ ID NO:902), YP0381 (SEQ ID NO:946), YP0337 (SEQ ID NO:941), PT0633 (SEQ ID NO:883), YP0374 (SEQ ID NO:943), PT0710 (SEQ ID NO:894), YP0356 (SEQ ID NO:874), YP0385 (SEQ ID NO:948), YP0396 (SEQ ID NO:949), YP0388, YP0384 (SEQ ID NO:947), PT0688 (SEQ ID NO:891), YP0286 (SEQ ID NO:940), YP0377 (SEQ ID NO:944), PD1367 (SEQ ID NO:953), PD0901, and PD0898 (SEQ ID NO:954). Examples of nitrogen-inducible promoters include PT0863 (SEQ ID NO:903), PT0829 (SEQ ID NO:899), PT0665 (SEQ ID NO:886), and PT0886 (SEQ ID NO:905). Examples of shade-inducible promoters include PR0924 and PT0678 (SEQ ID NO:889).

Basal Promoters

A basal promoter is the minimal sequence necessary for assembly of a transcription complex required for transcription initiation. Basal promoters frequently include a "TATA box" element that may be located between about 15 and about 35 nucleotides upstream from the site of transcription initiation. Basal promoters also may include a "CCAAT box" element (typically the sequence CCAAT) and/or a GGGCG sequence, which can be located between about 40 and about 200 nucleotides, typically about 60 to about 120 nucleotides, upstream from the transcription start site.

Other Promoters

Other classes of promoters include, but are not limited to, leaf-preferential, stem/shoot-preferential, callus-preferential, trichome cell-preferential, guard cell-preferential such as PT0678 (SEQ ID NO:889), tuber-preferential, parenchyma cell-preferential, and senescence-preferential promoters. Promoters designated YP0086 (SEQ ID NO:911), YP0188 (SEQ ID NO:933), YP0263 (SEQ ID NO:937), PT0758 (SEQ ID NO:898), PT0743 (SEQ ID NO:897), PT0829 (SEQ ID NO:899), YP0119 (SEQ ID NO:924), and YP0096 (SEQ ID NO:914), as described in the above-referenced patent applications, may also be useful.

Other Regulatory Regions

A 5' untranslated region (UTR) can be included in nucleic acid constructs described herein. A 5' UTR is transcribed, but is not translated, and lies between the start site of the transcript and the translation initiation codon and may include the +1 nucleotide. A 3' UTR can be positioned between the translation termination codon and the end of the transcript. UTRs can have particular functions such as increasing mRNA stability or attenuating translation. Examples of 3' UTRs include, but are not limited to, polyadenylation signals and transcription termination sequences, e.g., a nopaline synthase termination sequence.

It will be understood that more than one regulatory region may be present in a recombinant polynucleotide, e.g., introns, enhancers, upstream activation regions, transcription terminators, and inducible elements. Thus, more than one regulatory region can be operably linked to the sequence of a polynucleotide encoding a low light-tolerance polypeptide.

Regulatory regions, such as promoters for endogenous genes, can be obtained by chemical synthesis or by subcloning from a genomic DNA that includes such a regulatory region. A nucleic acid comprising such a regulatory region can also include flanking sequences that contain restriction enzyme sites that facilitate subsequent manipulation.

Sequences of Interest and Plants and Plant Cells Containing the Same

Plant cells and plants described herein are useful because expression of a sequence of interest can be modulated to achieve a desired amount and/or specificity in expression by selecting an appropriate association of regulatory region and regulatory protein. A sequence of interest operably linked to a regulatory region can encode a polypeptide or can regulate the expression of a polypeptide. A sequence of interest that encodes a polypeptide can encode a plant polypeptide, a non-plant polypeptide, e.g., a mammalian polypeptide, a modified polypeptide, a synthetic polypeptide, or a portion of a polypeptide. A sequence of interest can be endogenous, i.e., unmodified by recombinant DNA technology from the sequence and structural relationships that occur in nature and operably linked to the unmodified regulatory region. Alternatively, a sequence of interest can be an exogenous nucleic acid. In some embodiments, a sequence of interest is transcribed into an anti-sense molecule.

More than one sequence of interest can be present in a plant, e.g., two, three, four, five, six, seven, eight, nine, or ten sequences of interest can be present in a plant. If such sequences are exogenous nucleic acids, each sequence of interest can be present on the same nucleic acid construct in such embodiments. Alternatively, each exogenous sequence of interest can be present on separate nucleic acid constructs. The regulatory region operably linked to each sequence of interest can be the same or can be different. In addition, one or more nucleotide sequences encoding a regulatory protein can be included on a nucleic acid construct that is the same as or separate from that containing an associated regulatory region(s) operably linked to a sequence(s) of interest. The regulatory region operably linked to each sequence encoding a regulatory protein can be the same or different.

Terpenoid Biosynthesis Sequences

In certain cases, a sequence of interest can be an endogenous or exogenous sequence associated with terpenoid biosynthesis. For example, a transgenic plant cell containing a recombinant nucleic acid encoding a regulatory protein can be effective for modulating the amount and/or rate of biosynthesis of one or more terpenoid compounds. Such effects on terpenoid compounds typically occur via modulation of transcription of one or more endogenous or exogenous sequences of interest operably linked to an associated regulatory region, e.g., endogenous genes involved in terpenoid biosynthesis, such as native enzymes or regulatory proteins in terpenoid biosynthesis pathways, or exogenous sequences involved in terpenoid biosynthesis pathways introduced via a recombinant nucleic acid construct into a plant cell.

In some embodiments, the coding sequence can encode a polypeptide involved in terpenoid biosynthesis, e.g., an enzyme involved in biosynthesis of the terpenoid compounds described herein, or a regulatory protein (such as a transcription factor) involved in the biosynthesis pathways of the terpenoid compounds described herein. Other components that may be present in a sequence of interest include introns, enhancers, upstream activation regions, and inducible elements.

A suitable sequence of interest can encode an enzyme involved in isoprenoid biosynthesis via the mevalonic acid pathway, such as acetyl CoA acetyl (ACA) transferase (EC 2.3.1.9), hydroxy methyl glutaryl-CoA (HMG-CoA) synthase (EC 4.1.3.5), hydroxy methyl glutaryl-CoA (HMG-CoA) reductase (EC 1.1.1.34), mevalonate kinase (EC 2.7.1.36), mevalonate phosphate kinase (EC 2.7.4.2), mevalonate pyrophosphate decarboxylase (EC 4.1.1.33), or isopentenyl pyrophosphate (IPP) isomerase (EC 5.3.3.2).

In some cases, a sequence of interest can be an enzyme involved in isoprenoid biosynthesis via the deoxyxylulose phosphate pathway such as deoxyxylulose phosphate synthase, deoxyxylulose phosphate reductoisomerase, diphosphocytidyl methylerythritol transferase, diphosphocytidyl methylerythritol kinase, methylerythritol phosphocytidine diphosphate synthase, hydroxymethyl butiryl diphosphate synthase, or isopentenyl diphosphate synthase.

In yet other cases, a sequence of interest is an enzyme involved in biosynthesis of monoterpenes and monoterpene-derived compounds, e.g., an enzyme such as geranyl diphosphate synthase (EC 2.5.1.1), β-ocimene synthase, pinene synthase (EC 4.2.3.14), limonene synthase (EC 4.2.3.16), 1,8 cineole synthase, myrcene synthase (EC 4.2.3.15), bornyl diphosphate synthase, (−)-isopiperitenone reductase (EC 5.3.3.11), (+)-pulegone reductase, (−)-menthone reductase, or sabinene synthase. In some embodiments, a sequence of interest is an enzyme involved in biosynthesis of sesquiterpenes and sesquiterpene-derived compounds, e.g., an enzyme such as farnesyl diphosphate synthase (EC 2.5.1.10), E-β-farnesene synthase, β-caryophyllene synthase, 5-epi-aristolochene synthase (EC 4.2.3.9), vetispiradiene synthase (EC 4.2.3.21), δ-cadinene synthase (EC 4.2.3.13), germacrene C synthase, E-α-bisabolene synthase, δ-selinene synthase, and γ-humulene synthase.

In some embodiments, a suitable sequence encodes an enzyme involved in biosynthesis of diterpenes and diterpene-derived compounds, e.g., an enzyme such as geranylgeranyl diphosphate synthase, ent-copalyl diphosphate synthase (EC 5.5.1.12), ent-kaurene synthase (EC 1.14.13.78), taxadiene synthase (EC 4.2.3. 17), casbene and cambrene synthase (EC 4.2.3.8), 3'-N-debenzoyl-2'-deoxytaxol N-benzoyltransferase, taxoid 2α-hydroxylase, taxoid 7β-hydroxylase, taxane 13α-hydroxylase (EC 1.14.13.77), taxane 10β-hydroxylase (EC 1.14.13.76), taxadiene 5α-hydroxylase (EC 1.14.99.37), taxadien-5α-ol-O-acetyltransferase, 10-deacetylbaccatin III-10β-O-acetyltransferase (EC 2.3.1.167), taxane 2α-O-benzoyltransferase, or abietadiene synthase (EC 4.2.3.18).

In some embodiments, a suitable sequence encodes an enzyme involved in triterpene biosynthesis, e.g., an enzyme such as squalene synthase, lupeol synthase, *Arabidopsis* pentacyclic synthase, or α- and β-amyrin synthases. In some embodiments, a suitable sequence encodes an enzyme involved in tetraterpene biosynthesis, e.g., an enzyme such as phytoene synthase (EC 2.5.1.32), phytoene desaturase, lycopene β-cyclase, lycopene ε-cyclase, β-carotene hydroxylase, ζ-carotene desaturase, zeaxanthin/antheraxanthin deepoxidase, or zeaxanthin/antheraxanthin epoxidase. In some embodiments, a suitable sequence encodes an enzyme involved in polyterpene biosynthesis, e.g., an enzyme such as farnesyl diphosphate synthase, geranyl diphosphate synthase, geranylgeranyl diphosphate synthase, or rubber transferase.

In certain embodiments, a suitable sequence encodes an enzyme involved in artemisinin biosynthesis, e.g., an enzyme such as amorpha-4,11-diene synthase or CYP71AV1. In some embodiments, a suitable sequence encodes an enzyme involved in tetrahydrocannabinol synthesis, e.g., an enzyme such as delta(1)-tetrahydrocannabinolic acid (THCA) synthase or geranyl diphosphate:olivetolate geranyltransferase (GOT). In some embodiments, a suitable sequence encodes elisabethatriene synthase. In some embodiments, a suitable sequence encodes an enzyme involved in sterol synthesis, e.g., an enzyme such as sterol methyl oxidase, C-8,7 sterol isomerase, or sterol methyl transferase2. In some embodiments, a suitable sequence encodes an enzyme involved in monoterpene indole alkaloid synthesis, e.g., an enzyme such as geraniol 10-hydroxylase, deoxyloganin 7-hydroxylase, or secologanin synthase.

Other Sequences of Interest

Other sequences of interest can encode a therapeutic polypeptide for use with mammals such as humans, e.g., as set forth in Table 1. In certain cases, a sequence of interest can encode an antibody or antibody fragment. An antibody or antibody fragment includes a humanized or chimeric antibody, a single chain Fv antibody fragment, an Fab fragment, and an F(ab)$_2$ fragment. A chimeric antibody is a molecule in which different portions are derived from different animal species, such as those having a variable region derived from a mouse monoclonal antibody and a human immunoglobulin constant region. Antibody fragments that have a specific binding affinity can be generated by known techniques. Such antibody fragments include, but are not limited to F(ab')$_2$ fragments that can be produced by pepsin digestion of an antibody molecule and Fab fragments that can be generated by reducing the disulfide bridges of F(ab')$_2$ fragments. Single chain Fv antibody fragments are formed by linking the heavy and light chain fragments of the Fv region via an amino acid bridge (e.g., 15 to 18 amino acids), resulting in a single chain polypeptide. Single chain Fv antibody fragments can be produced through standard techniques, such as those disclosed in U.S. Pat. No. 4,946,778. U.S. Pat. No. 6,303,341 discloses immunoglobulin receptors. U.S. Pat. No. 6,417,429 discloses immunoglobulin heavy- and light-chain polypeptides.

TABLE 1

Human therapeutic proteins

| | | |
|---|---|---|
| Bromelain | Humatrope ® | Proleukin ® |
| Chymopapain | Humulin ® (insulin) | Protropin ® |
| Papain ® | Infergen ® | Recombivax-HB ® |
| Activase ® | Interferon-gamma-1a | Recormon ® |
| Albutein ® | Interleukin-2 | Remicade ® (s-TNF-r) |
| Angiotensin II | Intron ® | ReoPro ® |
| Asparaginase | Leukine ® (GM-CSF) | Retavase ® (TPA) |
| Avonex ® | Nartogastrim ® | Roferon-A ® |
| Betaseron ® | Neumega ® | Pegaspargas |
| BioTropin ® | Neupogen ® | Prandin ® |
| Cerezyme ® | Norditropin ® | Procrit ® |
| Enbrel ® (s-TNF-r) | Novolin ® (insulin) | Filgastrim ® |
| Engerix-B ® | Nutropin ® | Genotropin ® |
| Epogen ® | Oncaspar ® | Geref ® |
| Sargramostim | Tripedia ® | Trichosanthin |
| TriHIBit ® | Venoglobin-S ® (HIG) | |

A sequence of interest can encode a polypeptide or result in a transcription product anti-sense molecule that confers insect resistance, bacterial disease resistance, fungal disease resistance, viral disease resistance, nematode disease resistance, herbicide resistance, enhanced grain composition or quality, enhanced nutrient composition, nutrient transporter functions, enhanced nutrient utilization, enhanced environmental stress tolerance, reduced mycotoxin contamination, female sterility, a selectable marker phenotype, a screenable marker phenotype, a negative selectable marker phenotype, or altered plant agronomic characteristics. Specific examples include, without limitation, a chitinase coding sequence and a glucan endo-1,3-β-glucosidase coding sequence. In some embodiments, a sequence of interest encodes a bacterial ESPS synthase that confers resistance to glyphosate herbicide or a phosphinothricin acetyl transferase coding sequence that confers resistance to phosphinothricin herbicide.

A sequence of interest can encode a polypeptide involved in the production of industrial or pharmaceutical chemicals, modified and specialty oils, enzymes, or renewable non-foods such as fuels and plastics, vaccines and antibodies. U.S. Pat. No. 5,824,779 discloses phytase-protein-pigmenting concentrate derived from green plant juice. U.S. Pat. No. 5,900,525 discloses animal feed compositions containing phytase derived from transgenic alfalfa. U.S. Pat. No. 6,136, 320 discloses vaccines produced in transgenic plants. U.S. Pat. No. 6,255,562 discloses insulin. U.S. Pat. No. 5,958,745 discloses the formation of copolymers of 3-hydroxy butyrate and 3-hydroxy valerate. U.S. Pat. No. 5,824,798 discloses starch synthases. U.S. Pat. No. 6,087,558 discloses the production of proteases in plants. U.S. Pat. No. 6,271,016 discloses an anthranilate synthase gene for tryptophan overproduction in plants.

Methods of Inhibiting Expression of a Sequence of Interest

The polynucleotides and recombinant vectors described herein can be used to express or inhibit expression of a gene, such as an endogenous gene involved in terpenoid biosynthesis, e.g., to alter terpenoid biosynthetic pathways in a plant species of interest. The term "expression" refers to the process of converting genetic information of a polynucleotide into RNA through transcription, which is catalyzed by an enzyme, RNA polymerase, and into protein, through translation of mRNA on ribosomes. "Up-regulation" or "activation" refers to regulation that increases the production of expression products (mRNA, polypeptide, or both) relative to basal or native states, while "down-regulation" or "repression" refers to regulation that decreases production of expression products (mRNA, polypeptide, or both) relative to basal or native states.

"Modulated level of gene expression" as used herein refers to a comparison of the level of expression of a transcript of a gene or the amount of its corresponding polypeptide in the presence and absence of a regulatory protein described herein, and refers to a measurable or observable change in the level of expression of a transcript of a gene or the amount of its corresponding polypeptide relative to a control plant or plant cell under the same conditions (e.g., as measured through a suitable assay such as quantitative RT-PCR, a Northern blot, a Western blot, or through an observable change in phenotype, chemical profile, or metabolic profile). A modulated level of gene expression can include up-regulated or down-regulated expression of a transcript of a gene or polypeptide relative to a control plant or plant cell under the same conditions. Modulated expression levels can occur under different environmental or developmental conditions or in different locations than those exhibited by a plant or plant cell in its native state.

A number of nucleic acid based methods, including antisense RNA, co-suppression, ribozyme directed RNA cleavage, and RNA interference (RNAi) can be used to inhibit protein expression in plants. Antisense technology is one well-known method. In this method, a nucleic acid segment from a gene to be repressed is cloned and operably linked to a promoter so that the antisense strand of RNA is transcribed. The recombinant vector is then transformed into plants, as described above, and the antisense strand of RNA is produced. The nucleic acid segment need not be the entire sequence of the gene to be repressed, but typically will be substantially complementary to at least a portion of the sense strand of the gene to be repressed. Generally, higher homology can be used to compensate for the use of a shorter sequence. Typically, a sequence of at least 30 nucleotides is used, e.g., at least 40, 50, 80, 100, 200, 500 nucleotides or more.

Constructs containing operably linked nucleic acid molecules in the sense orientation can also be used to inhibit the expression of a gene. The transcription product can be similar or identical to the sense coding sequence of a polypeptide of interest. The transcription product can also be unpolyadenylated, lack a 5' cap structure, or contain an unsplicable intron. Methods of co-suppression using a full-length cDNA as well as a partial cDNA sequence are known in the art. See, e.g., U.S. Pat. No. 5,231,020.

In another method, a nucleic acid can be transcribed into a ribozyme, or catalytic RNA, that affects expression of an mRNA. See, U.S. Pat. No. 6,423,885. Ribozymes can be designed to specifically pair with virtually any target RNA and cleave the phosphodiester backbone at a specific location, thereby functionally inactivating the target RNA. Heterologous nucleic acids can encode ribozymes designed to cleave particular mRNA transcripts, thus preventing expression of a polypeptide. Hammerhead ribozymes are useful for destroying particular mRNAs, although various ribozymes that cleave mRNA at site-specific recognition sequences can be used. Hammerhead ribozymes cleave mRNAs at locations dictated by flanking regions that form complementary base pairs with the target mRNA. The sole requirement is that the target RNA contain a 5'-UG-3' nucleotide sequence. The construction and production of hammerhead ribozymes is known in the art. See, for example, U.S. Pat. No. 5,254,678 and WO 02/46449 and references cited therein. Hammerhead ribozyme sequences can be embedded in a stable RNA such as a transfer RNA (tRNA) to increase cleavage efficiency in vivo. Perriman et al., *Proc. Natl. Acad. Sci. USA*, 92(13): 6175-6179 (1995); de Feyter and Gaudron, Methods in Molecular Biology, Vol. 74, Chapter 43, "Expressing Ribozymes in Plants", Edited by Turner, P. C., Humana Press Inc., Totowa, N.J. RNA endoribonucleases which have been described, such as the one that occurs naturally in *Tetrahymena thermophila*, can be useful. See, for example, U.S. Pat. Nos. 4,987,071 and 6,423,885.

RNAi can also be used to inhibit the expression of a gene. For example, a construct can be prepared that includes a sequence that is transcribed into an interfering RNA. Such an RNA can be one that can anneal to itself, e.g., a double stranded RNA having a stem-loop structure. One strand of the stem portion of a double stranded RNA comprises a sequence that is similar or identical to the sense coding sequence of the polypeptide of interest, and that is from about 10 nucleotides to about 2,500 nucleotides in length. The length of the sequence that is similar or identical to the sense coding sequence can be from 10 nucleotides to 500 nucleotides, from 15 nucleotides to 300 nucleotides, from 20 nucleotides to 100 nucleotides, or from 25 nucleotides to 100 nucleotides. The other strand of the stem portion of a double stranded RNA comprises a sequence that is similar or identical to the antisense strand of the coding sequence of the polypeptide of interest, and can have a length that is shorter, the same as, or longer than the corresponding length of the sense sequence. The loop portion of a double stranded RNA can be from 10 nucleotides to 5,000 nucleotides, e.g., from 15 nucleotides to 1,000 nucleotides, from 20 nucleotides to 500 nucleotides, or from 25 nucleotides to 200 nucleotides. The loop portion of the RNA can include an intron. A construct including a sequence that is transcribed into an interfering RNA is transformed into plants as described above. Methods for using RNAi to inhibit the expression of a gene are known to those of skill in the art. See, e.g., U.S. Pat. Nos. 5,034,323; 6,326,527;

6,452,067; 6,573,099; 6,753,139; and 6,777,588. See also WO 97/01952; WO 98/53083; WO 99/32619; WO 98/36083; and U.S. Patent Publications 20030175965, 20030175783, 20040214330, and 20030180945.

In some nucleic-acid based methods for inhibition of gene expression in plants, a suitable nucleic acid can be a nucleic acid analog. Nucleic acid analogs can be modified at the base moiety, sugar moiety, or phosphate backbone to improve, for example, stability, hybridization, or solubility of the nucleic acid. Modifications at the base moiety include deoxyuridine for deoxythymidine, and 5-methyl-2'-deoxycytidine and 5-bromo-2'-deoxycytidine for deoxycytidine. Modifications of the sugar moiety include modification of the 2' hydroxyl of the ribose sugar to form 2'-O-methyl or 2'-O-allyl sugars. The deoxyribose phosphate backbone can be modified to produce morpholino nucleic acids, in which each base moiety is linked to a six-membered morpholino ring, or peptide nucleic acids, in which the deoxyphosphate backbone is replaced by a pseudopeptide backbone and the four bases are retained. See, for example, Summerton and Weller, 1997, *Antisense Nucleic Acid Drug Dev.*, 7:187-195; Hyrup et al., *Bioorgan. Med. Chem.*, 4:5-23 (1996). In addition, the deoxyphosphate backbone can be replaced with, for example, a phosphorothioate or phosphorodithioate backbone, a phosphoroamidite, or an alkyl phosphotriester backbone.

Transgenic Plant Cells and Plants

Provided herein are transgenic plant cells and plants comprising at least one recombinant nucleic acid construct or exogenous nucleic acid. A recombinant nucleic acid construct or exogenous nucleic acid can include a regulatory region as described herein, a nucleic acid encoding a regulatory protein as described herein, or both. In certain cases, a transgenic plant cell or plant comprises at least two recombinant nucleic acid constructs or exogenous nucleic acids, one including a regulatory region, and one including a nucleic acid encoding the associated regulatory protein.

A plant or plant cell used in methods of the invention contains a recombinant nucleic acid construct as described herein. A plant or plant cell can be transformed by having a construct integrated into its genome, i.e., can be stably transformed. Stably transformed cells typically retain the introduced nucleic acid with each cell division. A plant or plant cell can also be transiently transformed such that the construct is not integrated into its genome. Transiently transformed cells typically lose all or some portion of the introduced nucleic acid construct with each cell division such that the introduced nucleic acid cannot be detected in daughter cells after a sufficient number of cell divisions. Both transiently transformed and stably transformed transgenic plants and plant cells can be useful in the methods described herein.

Typically, transgenic plant cells used in methods described herein constitute part or all of a whole plant. Such plants can be grown in a manner suitable for the species under consideration, either in a growth chamber, a greenhouse, or in a field. Transgenic plants can be bred as desired for a particular purpose, e.g., to introduce a recombinant nucleic acid into other lines, to transfer a recombinant nucleic acid to other species or for further selection of other desirable traits. Alternatively, transgenic plants can be propagated vegetatively for those species amenable to such techniques. Progeny includes descendants of a particular plant or plant line. Progeny of an instant plant include seeds formed on $F_1$, $F_2$, $F_3$, $F_4$, $F_5$, $F_6$ and subsequent generation plants, or seeds formed on $BC_1$, $BC_2$, $BC_3$, and subsequent generation plants, or seeds formed on $F_1BC_1$, $F_1BC_2$, $F_1BC_3$, and subsequent generation plants. Seeds produced by a transgenic plant can be grown and then selfed (or outcrossed and selfed) to obtain seeds homozygous for the nucleic acid construct.

Transgenic plant cells growing in suspension culture, or tissue or organ culture, can be useful for extraction of terpenoid compounds. For the purposes of this invention, solid and/or liquid tissue culture techniques can be used. When using solid medium, transgenic plant cells can be placed directly onto the medium or can be placed onto a filter film that is then placed in contact with the medium. When using liquid medium, transgenic plant cells can be placed onto a floatation device, e.g., a porous membrane that contacts the liquid medium. Solid medium typically is made from liquid medium by adding agar. For example, a solid medium can be Murashige and Skoog (MS) medium containing agar and a suitable concentration of an auxin, e.g., 2,4-dichlorophenoxyacetic acid (2,4-D), and a suitable concentration of a cytokinin, e.g., kinetin.

When transiently transformed plant cells are used, a reporter sequence encoding a reporter polypeptide having a reporter activity can be included in the transformation procedure and an assay for reporter activity or expression can be performed at a suitable time after transformation. A suitable time for conducting the assay typically is about 1-21 days after transformation, e.g., about 1-14 days, about 1-7 days, or about 1-3 days. The use of transient assays is particularly convenient for rapid analysis in different species, or to confirm expression of a heterologous regulatory protein whose expression has not previously been confirmed in particular recipient cells.

Techniques for introducing nucleic acids into monocotyledonous and dicotyledonous plants are known in the art, and include, without limitation, *Agrobacterium*-mediated transformation, viral vector-mediated transformation, electroporation and particle gun transformation, e.g., U.S. Pat. Nos. 5,538,880, 5,204,253, 6,329,571 and 6,013,863. If a cell or tissue culture is used as the recipient tissue for transformation, plants can be regenerated from transformed cultures if desired, by techniques known to those skilled in the art. See, e.g., Niu et al., *Plant Cell Rep.* V19:304-310 (2000); Chang and Yang, *Bot. Bull. Acad. Sin.*, V37:35-40 (1996), and Han et al., Biotechnology in Agriculture and Forestry, V44:291 (ed. by Y. P. S. Bajaj), Springer-Verlag, (1999).

A population of transgenic plants can be screened and/or selected for those members of the population that have a desired trait or phenotype conferred by expression of the transgene. Selection and/or screening can be carried out over one or more generations, which can be useful to identify those plants that have a desired trait, such as an increased level of one or more terpenoid compounds. Selection and/or screening can also be carried out in more than one geographic location. In some cases, transgenic plants can be grown and selected under conditions which induce a desired phenotype or are otherwise necessary to produce a desired phenotype in a transgenic plant. In addition, selection and/or screening can be carried out during a particular developmental stage in which the phenotype is exhibited by the plant.

Plant Species

The polynucleotides and vectors described herein can be used to transform a number of monocotyledonous and dicotyledonous plants and plant cell systems. A suitable group of plant species includes dicots, such as alfalfa, coffee, cotton, rapeseed (high erucic acid and canola), safflower, soybean, or sunflower. Also suitable are monocots such as amaranth, barley, corn, millet, oat, rice, rye, sorghum, or wheat. Also suitable are vegetable crops or root crops such as beans (including kidney beans, lima beans, dry beans, green beans), broccoli, carrot, lettuce, onion, peas, popcorn, potato, sweet corn, tomato, and the like. Also suitable are fruit crops such as apple, banana, cherry, grape, grapefruit, lemon, mango, melon (e.g., watermelon, cantaloupe), orange, palm, peach, pear, pineapple, plum, and strawberry.

Thus, the methods and compositions described herein can be utilized with dicotyledonous plants belonging to the orders Aristochiales, Asterales, Batales, Campanulales, Capparales, Caiyophyllales, Casuarinales, Celastrales, Cornales, Diapensales, Dilleniales, Dipsacales, Ebenales, Ericales, Eucomiales, Euphorbiales, Fabales, Fagales, Gentianales, Geraniales, Haloragales, Hamamelidales, Illiciales, Juglandales, Lamiales, Laurales, Lecythidales, Leitneriales, Magniolales, Malvales, Myricales, Myrtales, Nyinphaeales, Papeverales, Piperales, Plantaginales, Plumbaginales, Podostemales, Polemoniales, Polygalales, Polygonales, Primulales, Proteales, Rafflesiales, Ranunculales, Rhamnales, Rosales, Rubiales, Salicales, Santales, Sapindales, Sarraceniaceae, Scrophulariales, Theales, Trochodendrales, Umbellales, Urticales, and Violales. Methods and compositions described herein can also be utilized with monocotyledonous plants belonging to the orders Alismatales, Arales, Arecales, Bromeliales, Commelinales, Cyclanthales, Cyperales, Eriocaulales, Hydrocharitales, Juncales, Lilliales, Najadales, Orchidales, Pandanales, Poales, Restionales, Triuridales, Typhales, and Zingiberales, or with plants belonging to Gymmospermae, e.g., Cycadales, Ginkgoales, Gnetales, and Pinales.

The invention has use over a broad range of plant species, including species from the genera *Allium, Alseodaphize, Anacardium, Arachis, Asparagus, Atropa, Avena, Beilschmiedia, Brassica, Citrus, Citrullus, Capsicum, Carthainus, Catharanthus, Cocculus, Cocos, Coffea, Croton, Cucumis, Cucurbita, Daucus, Duguetia, Elaeis, Eschscholzia, Ficus, Fragaria, Glaucium, Glycine, Gossypium, Helianthus, Heterocallis, Hevea, Hordeum, Hyoscyamus, Lactuca, Landolphia, Linum, Litsea, Lolium, Lupinus, Lycopersicon, Malus, Manihot, Majorana, Medicago, Musa, Nicotiana, Olea, Oryza, Panicum, Pannesetum, Papaver, Parthenium, Persea, Phaseolus, Pinus, Pistachia, Pisum, Pyrus, Prunus, Raphanus, Rhizocarya, Ricinus, Secale, Senecio, Sinomenium, Sinapis, Solanum, Sorghum, Stephania, Theobroma, Trigonella, Triticum, Vicia, Vinca, Vitis, Vigna*, and *Zea*.

A particularly suitable group of species with which to practice the invention include terpenoid producing plants, e.g., plants from the genera *Acokanthera, Aesculus, Alstroemeria, Anamirta, Andrographis, Artemisia, Betula, Bixa, Brassica, Calendula, Cannabis, Centella, Cephalotaxus, Chrysanthemum, Cinnamomum, Citrullus, Coffea, Coleus, Convallaria, Curcuma, Cymbopogan, Daphne, Digitalis, Dioscorea, Euphorbia, Fragaria, Glycine, Glycyrrhiza, Gossypium, Hevea, Isodon, Lactuca, Lavandula, Luffa, Lycopersicon, Mentha, Musa, Ocimum, Origanum, Parthenium, Rabdosia, Rosmarinus, Ruscus, Salvia, Simarouba, Solanum, Strophanthus, Tanacetum, Taxus, Thymus, Tripterygium, Triticum*, and *Vitis*, or genera and species listed in Table 2.

Terpenoid Compounds

Compositions and methods described herein are useful for producing one or more terpenoid compounds. In certain cases, a terpenoid compound can be a plant secondary metabolite. The regulatory proteins described previously can modulate transcription of sequences involved in the biosynthesis of terpenoid compounds. Thus, a transgenic plant or cell comprising a recombinant nucleic acid expressing such a regulatory protein can be effective for modulating the amount and/or rate of biosynthesis of one or more of such terpenoids in a plant containing the associated regulatory region, either as a genomic sequence or introduced in a recombinant nucleic acid construct.

An amount of one or more of any individual terpenoid compound can be modulated, e.g., increased or decreased, relative to a control plant not transgenic for the particular regulatory protein using the methods described herein. In certain cases, therefore, more than one terpenoid compound (e.g., two, three, four, five, six, seven, eight, nine, ten or even more terpenoid compounds) can have its amount modulated relative to a control plant or cell that is not transgenic for a regulatory protein described herein.

A number of different classes of terpenoid compounds, based on chemical and structural features, can be produced by the methods and compositions described herein. Such classes include, without limitation, monoterpenoids, monoterpenoid lactones, sesquiterpenoids, sesquiterpenoid lactones, diterpenoids, triterpenoids, carotenoids, steroids, sterols, isoprenoid polymers (e.g., natural latex), and mixed biosynthesis compounds such as terpene/polyketides. Terpenoid producing plants containing a recombinant nucleic acid construct described herein typically have a difference in the amount and/or rate of synthesis of one or more of terpenoid compounds, relative to a corresponding control plant or cell that is not transformed with the recombinant nucleic acid construct.

In some embodiments, a monoterpenoid compound is produced, e.g., geranyl diphosphate, linalyl acetate, S-(+)-carvone, R-(−)-carvone, nerol, menthol, β-ocimene, pinene, limonene, 1, 8 cineole, myrcene, (+)-bornyl diphosphate, (−)-isopiperitenone, (+)-pulegone, (−)-menthone, thujone, marinol, tetrahydrocannabinol, camphor, borneol, perillyl alcohol, thymol, sobrerol, or sabinene.

In some embodiments, a sesquiterpene or sesquiterpene-derived compound is produced, such as farnesyl diphosphate, E-β-faranesene, β-caryophyllene, 5-epi-aristolochene, vetispiradiene, δ-cadinene, germacrene C, E-α-bisabolene, δ-selinene, parthenolide, artemisinin, artemisin, artemether, santonin, parthenolide, gossypol, manoalide, acetyldigoxin, digoxin, deslanoside, digitalin, digitoxin, lanatosides A, B and C or γ-humulene.

In some embodiments, a diterpene or diterpene-derived compound is produced such as geranylgeranyl diphosphate, ent-copalyl diphosphate, ent-kaurene, taxadiene, taxol, baccatin III, calanolide A, ginkgolides, casbene, abietadiene, andrographolide, neoandrographolide, forskolin, resiniferatoxin, pseudopterosin C, methopterosin, carnosic acid, camosol, tanshinone II-A, saprorthoquinone, triptolide or cambrene.

In some embodiments, a triterpenoid or steroid is produced, such as squalene, lupeol, α-amyrin, β-amyrin, glycyrrhizin, β-sitosterol, sitostanol, stigmasterol, campesterol, ergosterol, diosgenin, aescin, picrotoxin, betulinic acid, asiaticoside, cucurbitacin E, glycyrrhizin, diosgenin or ruscogenin.

In certain embodiments, a tetra- or polyterpene is produced, such as lycopene, β-carotene, ζ-carotene, lutein, zeaxanthin, and antheraxanthin, phytoene, bixin and astaxanthin. Other terpenoid compounds that can be produced and/or extracted by methods described herein include yuanhuacin, yuanhuadin, glaucarubin, convallatoxin, squalamine, ouabain, strophanthidin, or those listed in Table 2.

TABLE 2

Terpenoid compounds and sources thereof

| Terpenoid Name | Biological Source(s) |
| --- | --- |
| Aescin (a.k.a. escin) | *Aesculus hippocastanum* |
| Picrotoxin | *Anamirta cocculus* |
| Andrographolide | *Andrographis paniculata* |
| Neoandrographolide | *Andrographis paniculata* |
| Thujone | *Artemisia absinthium* |
| Artemisinin | *Artemisia annua* |
| Artemisin | *Artemisia* spp. |
| Artemether | *Artemisia annua* |
| Santonin | *Artemisia* spp. |
| Betulinic acid | *Betula* spp. |
| Bixin | *Bixa orellana* |
| Marinol | *Cannabis sativa* |
| Tetrahydrocannabinol | *Cannabis sativa* |
| Asiaticoside | *Centella asiatica* |
| Parthenolide | *Chrysanthemum parthenium, Tanacetum parthenium* |
| Camphor | *Cinnamomum camphora* |
| Cucurbitacin E | *Citrullus* spp. *Luffa* spp. |
| Forskolin | *Coleus forskohlii* |
| Borneol | *Curcuma aromatica, Cinnamomum camphora* |
| Perillyl alcohol | *Cymbopogan polyneuros* |
| Yuanhuacin | *Daphne genkwa* |
| Yuanhuadin | *Daphne genkwa* |
| Resiniferatoxin | *Euphorbia resinifera, Euphorbia* spp. |
| Tocopherols | *Glycine max* and others |
| Glycyrrhizin | *Glycyrrhiza glabra* |
| Gossypol | *Gossypium* spp. |
| Astaxanthin | Green algae |
| Natural latex | *Parthenium argentatum* and *Hevea* spp. |
| Ponicidin | *Isodon japonicus, Rabdosia rubescens* and *Rabdosia rosthornii* |
| Manoalide | Marine sponge - *Luffariela variabilis* |
| Pseudopterosin C | Marine octocoral - *Pseudopterogorgia elisabethae* |
| Zeaxanthin | Marine algae |
| Menthol | *Mentha* spp. |
| Methopterosin | Marine octocoral - *Pseudopterogorgia* sp. |
| Carnosic acid | *Salvia* spp, *Rosmarinus officinalis* |
| Carnosol | *Salvia* spp, *Rosmarinus officinalis* |
| Tanshinone II-A | *Salvia miltiorrhiza* |
| Saprorthoquinone | *Salvia prionitis, Salvia hypargeia* |
| Glaucarubin | *Simarouba glauca* |
| Taxol | *Taxus* spp. |
| Thymol | *Thymus vulgaris* |
| Triptolide | *Tripterygium wilfordii* |
| Sobrerol | |
| Lycopene | *Lycopersicon esculentum* |
| Lutein | *Lycopersicon esculentum* |
| Tulipalin | *Alstroemeria* spp. |
| Convallatoxin | *Convallaria majalis* |
| Acetyldigoxin | *Digitalis lanata* |
| Digoxin | *Digitalis purpurea, Digitalis lanata* |
| Deslanoside | *Digitalis* spp. |
| Digitalin | *Digitalis* spp. |
| Digitoxin | *Digitalis* spp. |
| Lanatosides A, B, C | *Digitalis* spp. |
| Diosgenin | *Dioscorea* spp. |
| Sitostanol | *Calendula officinalis, Glycine max* |
| Beta-sitosterol | Many plants |
| Squalamine | Marine shark - *Squalus acanthias* |
| Ruscogenin | *Ruscus aculeatus, Ruscus* spp. |
| Ouabain | *Strophanthus* spp, *Acokanthera* spp. |
| Strophanthidin | *Strophanthus* spp. |
| Stigmasterol | Many plants |
| Calanolide A | *Calophyllum lanigerum* |

The amount of one or more terpenoid compounds can be increased or decreased in transgenic cells or tissues expressing a regulatory protein as described herein. An increase can be from about 1.2-fold to about 150-fold, about 1.3-fold to about 20-fold, or about 1.2-fold to about 3-fold, or about 1.3-fold to about 2-fold, or about 1.4-fold to about 3-fold, or about 2-fold to about 4-fold, or about 2-fold to about 5-fold, or about 1.5-fold to 7-fold, or about 3-fold to about 4-fold, or about 3-fold to about 7-fold, or about 4-fold to about 8-fold, or about 5-fold to about 10-fold, or about 10-fold to about 15-fold, or about 12-fold to about 18-fold, or about 14-fold to about 22-fold, or about 18-fold to about 30-fold, or about 10-fold to about 100-fold, or about 30-fold to about 100-fold, or about 75-fold to about 130-fold, or about 5-fold to about 50-fold, or about 40-fold to about 150-fold higher than the amount in corresponding control cells or tissues that lack the recombinant nucleic acid encoding the regulatory protein.

In other embodiments, the terpenoid compound that is increased in transgenic cells expressing a regulatory protein as described herein is either not produced or is not detectable in a corresponding control cell that lacks the recombinant nucleic acid encoding the regulatory protein. Thus, in such embodiments, the increase in such a terpenoid compound is infinitely high as compared to corresponding control cells or tissues that lack the recombinant nucleic acid encoding the regulatory protein. For example, in certain cases, a regulatory protein described herein may activate a biosynthetic pathway in a plant that is not normally activated or operational in a control plant, and one or more new terpenoids that were not previously produced in that plant species can be produced.

The increase in amount of one or more terpenoids can be restricted in some embodiments to particular tissues and/or organs, relative to other tissues and/or organs. For example, a transgenic plant can have an increased amount of an terpenoid in leaf tissue relative to root or floral tissue.

In other embodiments, the amounts of one or more terpenoids are decreased in transgenic cells expressing a regulatory protein as described herein. A decrease ratio can be expressed as the ratio of the terpenoid in such a transgenic cell on a weight basis (e.g., fresh or freeze dried weight basis) as compared to the terpenoid in a corresponding control cell that lacks the recombinant nucleic acid encoding the regulatory protein. The decrease ratio can be from about 0.05 to about 0.90. In certain cases, the ratio can be from about 0.2 to about 0.6, or from about 0.4 to about 0.6, or from about 0.3 to about 0.5, or from about 0.2 to about 0.4.

In certain embodiments, the terpenoid compound that is decreased in transgenic cells expressing a regulatory protein as described herein is decreased to an undetectable level as compared to the level in corresponding control cells that lack the recombinant nucleic acid encoding the regulatory protein. Thus, in such embodiments, the decrease ratio in such a terpenoid compound is zero.

The decrease in amount of one or more terpenoids can be restricted in some embodiments to particular tissues and/or organs, relative to other tissues and/or organs. For example, a transgenic plant can have a decreased amount of a terpenoid in leaf tissue relative to root or floral tissue.

In some embodiments, the amounts of two or more terpenoids are increased and/or decreased, e.g., the amounts of two, three, four, five, six, seven, eight, nine, ten, or more, terpenoid compounds are independently increased and/or decreased. The amount of a terpenoid compound can be determined by known techniques, e.g., by extraction of terpenoid compounds followed by gas chromatography-mass spectrometry (GC-MS) or liquid chromatography-mass spectrometry (LC-MS). If desired, the structure of the terpenoid compound can be confirmed by GC-MS, LC-MS, nuclear magnetic resonance and/or other known techniques.

Methods of Screening for Associations and Modulating Expression of Sequences of Interest Provided herein are methods of screening for novel regulatory region-regulatory protein association pairs. The described methods can thus determine whether or not a given regulatory protein can activate a given regulatory region (e.g., to modulate expression of a sequence of interest operably linked to the given regulatory region).

A method of determining whether or not a regulatory region is activated by a regulatory protein can include determining whether or not reporter activity is detected in a plant cell transformed with a recombinant nucleic acid construct comprising a test regulatory region operably linked to a nucleic acid encoding a polypeptide having the reporter activity and with a recombinant nucleic acid construct comprising a nucleic acid encoding a regulatory protein described herein. Detection of the reporter activity indicates that the test regulatory region is activated by the regulatory protein. In certain cases, the regulatory region is a regulatory region as described herein, e.g., comprising a nucleic acid sequence having 80% or greater sequence identity to a regulatory region as set forth in SEQ ID NOs:856-870.

For example, a plant can be made that is stably transformed with a sequence encoding a reporter operably linked to the regulatory region under investigation. The plant is inoculated with *Agrobacterium* containing a sequence encoding a regulatory protein on a Ti plasmid vector. A few days after inoculation, the plant tissue is examined for expression of the reporter, or for detection of reporter activity associated with the reporter. If reporter expression or activity is observed, it can be concluded that the regulatory protein increases transcription of the reporter coding sequence, such as by binding the regulatory region. A positive result indicates that expression of the regulatory protein being tested in a plant would be effective for increasing the in planta amount and/or rate of biosynthesis of one or more sequences of interest operably linked to the associated regulatory region.

Similarly, a method of determining whether or not a regulatory region is activated by a regulatory protein can include determining whether or not reporter activity is detected in a plant cell transformed with a recombinant nucleic acid construct comprising a regulatory region as described herein operably linked to a reporter nucleic acid, and with a recombinant nucleic acid construct comprising a nucleic acid encoding a test regulatory protein. Detection of reporter activity indicates that the regulatory region is activated by the test regulatory protein. In certain cases, the regulatory protein is a regulatory protein as described herein, e.g., comprising a polypeptide sequence having 80% or greater sequence identity to a polypeptide sequence set forth in any of SEQ ID NO:2, SEQ ID NO:4, SEQ ID NOs:6-10, SEQ ID NO:12, SEQ ID NOs:14-17, SEQ ID NOs:19-20, SEQ ID NOs:22-25, SEQ ID NO:27, SEQ ID NOs:29-34, SEQ ID NOs:36-37, SEQ ID NO:39, SEQ ID NO:41, SEQ ID NO:43, SEQ ID NO:45, SEQ ID NOs:47-49, SEQ ID NO:51, SEQ ID NOs:53-56, SEQ ID NOs:58-64, SEQ ID NOs:66-67, SEQ ID NO:69, SEQ ID NO:71, SEQ ID NOs:73-74, SEQ ID NO:76, SEQ ID NO:78, SEQ ID NOs:80-82, SEQ ID NO:84, SEQ ID NO:86, SEQ ID NOs:88-90, SEQ ID NOs:92-95, SEQ ID NO:97, SEQ ID NOs:99-102, SEQ ID NO:104, SEQ ID NO:106, SEQ ID NOs:108-111, SEQ ID NO:113, SEQ ID NOs:115-117, SEQ ID NOs:119-122, SEQ ID NOs:124-127, SEQ ID NO:129, SEQ ID NOs:131-134, SEQ ID NOs:136-139, SEQ ID NOs:141-142, SEQ ID NOs:144-147, SEQ ID NO:149, SEQ ID NOs:151-152, SEQ ID NO:154, SEQ ID NO:156, SEQ ID NOs:158-161, SEQ ID NOs:163-169, SEQ ID NO:171, SEQ ID NOs:173-175, SEQ ID NOs:177-181, SEQ ID NOs:183-188, SEQ ID NO:190, SEQ ID NOs:192-198, SEQ ID NOs:200-204, SEQ ID NOs:206-208, SEQ ID NOs:210-216, SEQ ID NOs:218-220, SEQ ID NOs:222-227, SEQ ID NOs:229-243, SEQ ID NOs:245-247, SEQ ID NOs:249-251, SEQ ID NOs:253-264, SEQ ID NOs:266-273, SEQ ID NO:275, SEQ ID NOs:277-279, SEQ ID NOs:281-285, SEQ ID NO:287, SEQ ID NO:289, SEQ ID NOs:291-292, SEQ ID NO:294, SEQ ID NO:296, SEQ ID NOs:298-300, SEQ ID NOs:302-303, SEQ ID NOs:305-307, SEQ ID NOs:309-310, SEQ ID NOs:312-317, SEQ ID NOs:319-320, SEQ ID NO:322, SEQ ID NOs:324-326, SEQ ID NOs:328-329, SEQ ID NO:331, SEQ ID NO:333, SEQ ID NOs:335-339, SEQ ID NOs:341-342, SEQ ID NOs:344-347, SEQ ID NOs:349-353, SEQ ID NOs:355-357, SEQ ID NOs:359-361, SEQ ID NOs:363-366, SEQ ID NOs:368-372, SEQ ID NOs:374-382, SEQ ID NOs:384-389, SEQ ID NOs:391-392, SEQ ID NOs:394-395, SEQ ID NO:397, SEQ ID NOs:399-401, SEQ ID NO:403, SEQ ID NOs:405-406, SEQ ID NOs:408-410, SEQ ID NOs:412-414, SEQ ID NOs:416-422, SEQ ID NOs:424-425, SEQ ID NOs:427-430, SEQ ID NOs:432-434, SEQ ID NOs:436-442, SEQ ID NO:444, SEQ ID NOs:446-449, SEQ ID NO:451, SEQ ID NOs:453-463, SEQ ID NO:465, SEQ ID NOs:467-474, SEQ ID NOs:476-481, SEQ ID NOs:483-486, SEQ ID NOs:488-494, SEQ ID NOs:496-503, SEQ ID NOs:505-507, SEQ ID NOs:509-511, SEQ ID NOs:513-522, SEQ ID NOs:524-538, SEQ ID NOs:540-544, SEQ ID NO:546, SEQ ID NOs:548-552, SEQ ID NOs:554-555, SEQ ID NOs:557-564, SEQ ID NOs:566-574, SEQ ID NOs:576-578, SEQ ID NOs:580-583, SEQ ID NO:585, SEQ ID NO:587, SEQ ID NOs:589-591, SEQ ID NO:593, SEQ ID NO:595, SEQ ID NO:597, SEQ ID NOs:599-602, SEQ ID NOs:604-605, SEQ ID NOs:607-609, SEQ ID NO:611, SEQ ID NOs:613-614, SEQ ID NO:616, SEQ ID NOs:618-620, SEQ ID NO:622, SEQ ID NOs:624-628, SEQ ID NOs:630-634, SEQ ID NOs:636-638, SEQ ID NO:640, SEQ ID NOs:642-644, SEQ ID NOs:646-652, SEQ ID NO:654, SEQ ID NOs:656-658, SEQ ID NOs:660-661, SEQ ID NOs:663-664, SEQ ID NOs:666-669, SEQ ID NOs:671-672, SEQ ID NO:674, SEQ ID NOs:676-677, SEQ ID NO:679, SEQ ID NOs:681-682, SEQ ID NO:684, SEQ ID NO:686, SEQ ID NO:688, SEQ ID NOs:690-691, SEQ ID NOs:693-694, SEQ ID NOs:696-697, SEQ ID NO:699, SEQ ID NO:701, SEQ ID NO:703, SEQ ID NO:705, SEQ ID NOs:707-708, SEQ ID NO:710, SEQ ID NOs:712-722, SEQ ID NO:724, SEQ ID NO:726, SEQ ID NO:728, SEQ ID NOs:730-732, SEQ ID NOs:734-736, SEQ ID NO:738, SEQ ID NO:740, SEQ ID NO:742, SEQ ID NOs:744-746, SEQ ID NO:748, SEQ ID NO:750, SEQ ID NOs:752-754, SEQ ID NOs:756-757, SEQ ID NO:759, SEQ ID NOs:761-766, SEQ ID NO:768, SEQ ID NO:770, SEQ ID NOs:772-797, SEQ ID NO:799, SEQ ID NO:801, SEQ ID NO:803, SEQ ID NO:805, SEQ ID NO:807, SEQ ID NOs:809-813, SEQ ID NOs:815-818, SEQ ID NO:820, SEQ ID NO:822, SEQ ID NO:824, SEQ ID NO:826, SEQ ID NO:828, SEQ ID NO:830, SEQ ID NO:832, SEQ ID NO:834, SEQ ID NO:836, SEQ ID NO:838, SEQ ID NO:840, SEQ ID NOs:842-847, SEQ ID NOs:849-850, SEQ ID NOs:852-853, SEQ ID NO:855, SEQ ID NO:956, or a consensus sequence set forth in any of FIGS. 1-115.

A transformation can be a transient transformation or a stable transformation, as discussed previously. The regulatory region and the nucleic acid encoding a test regulatory protein can be on the same or different nucleic acid constructs.

A reporter activity, such as an enzymatic or optical activity, can permit the detection of the presence of the reporter polypeptide in situ or in vivo, either directly or indirectly. For example, a reporter polypeptide can itself be bioluminescent upon exposure to light. A reporter polypeptide also can catalyze a chemical reaction in vivo that yields a detectable product that is localized inside or that is associated with a cell that expresses the chimeric polypeptide. Exemplary bioluminescent reporter polypeptides that emit light in the presence of additional polypeptides, substrates or cofactors include firefly luciferase and bacterial luciferase. Bioluminescent reporter polypeptides that fluoresce in the absence of additional proteins, substrates or cofactors when exposed to light having a wavelength in the range of 300 nm to 600 nm include, for example: amFP486, Mut15-amFP486, Mut32-amFP486, CNFP-MODCd1 and CNFP-MODCd2; asFP600, mut1-RNFP, NE-RNFP, d1RNFP and d2RNFP; cFP484, Δ19-cFP484 and Δ38-cFP484; dgFP512; dmFP592; drFP583, E5 drFP583, E8 drFP583, E5UP drFP583, E5down drFP583, E57 drFP583, AG4 drFP583 and AG4H drFP583; drFP583/dmFP592, drFP583/dmFP592-2G and drFP583/dmFP592-Q3; dsFP483; zFP506, N65M-zFP506, d1zFP506 and d2zFP506; zFP538, M128V-zFP538, YNFPM128V-MODCd1 and YNFPM128V-MODCd2; GFP; EGFP, ECFP, EYFP, EBFP, BFP2; d4EGFP, d2EGFP, and d1EGFP; and DsRed and DsRed1. See WO 00/34318; WO 00/34320; WO 00/34319; WO 00/34321; WO 00/34322; WO 00/34323; WO 00/34324; WO 00/34325; WO 00/34326; GenBank Accession No. AAB57606; Clontech User Manual, April 1999, PT2040-1, version PR94845; Li et al., *J Biol Chem* 1998, 273:34970-5; U.S. Pat. No. 5,777,079; and Clontech User Manual, October 1999, PT34040-1, version PR9×217. Reporter polypeptides that catalyze a chemical reaction that yields a detectable product include, for example, β-galactosidase or β-glucuronidase. Other reporter enzymatic activities for use in the invention include neomycin phosphotransferase activity and phosphinotricin acetyl transferase activity.

In some cases, it is known that a particular transcription factor can activate transcription from a particular terpenoid regulatory region(s), e.g., a regulatory region involved in terpenoid biosynthesis. In these cases, similar methods can also be useful to screen other regulatory regions, such as other regulatory regions involved in terpenoid biosynthesis, to determine whether they are activated by the same transcription factor. Thus, the method can comprise transforming a plant cell with a nucleic acid comprising a test regulatory region operably linked to a nucleic acid encoding a polypeptide having reporter activity. The plant cell can include a recombinant nucleic acid encoding a regulatory protein operably linked to a regulatory region that drives transcription of the regulatory protein in the cell. If reporter activity is detected, it can be concluded that the regulatory protein activates transcription mediated by the test regulatory region.

Provided herein also are methods to modulate expression of sequences of interest. Modulation of expression can be expression itself, an increase in expression, or a decrease in expression. Such a method can involve transforming a plant cell with, or growing a plant cell comprising, at least one recombinant nucleic acid construct. A recombinant nucleic acid construct can include a regulatory region as described above, e.g., comprising a nucleic acid having 80% or greater sequence identity to a regulatory region set forth in SEQ ID NOs:856-870, where the regulatory region is operably linked to a nucleic acid encoding a sequence of interest. In some cases, a recombinant nucleic acid construct can further include a nucleic acid encoding a regulatory protein as described above, e.g., comprising a polypeptide sequence having 80% or greater sequence identity to a polypeptide sequence set forth in any of SEQ ID NO:2, SEQ ID NO:4, SEQ ID NOs:6-10, SEQ ID NO:12, SEQ ID NOs:14-17, SEQ ID NOs:19-20, SEQ ID NOs:22-25, SEQ ID NO:27, SEQ ID NOs:29-34, SEQ ID NOs:36-37, SEQ ID NO:39, SEQ ID NO:41, SEQ ID NO:43, SEQ ID NO:45, SEQ ID NOs:47-49, SEQ ID NO:51, SEQ ID NOs:53-56, SEQ ID NOs:58-64, SEQ ID NOs:66-67, SEQ ID NO:69, SEQ ID NO:71, SEQ ID NOs:73-74, SEQ ID NO:76, SEQ ID NO:78, SEQ ID NOs: 80-82, SEQ ID NO:84, SEQ ID NO:86, SEQ ID NOs:88-90, SEQ ID NOs:92-95, SEQ ID NO:97, SEQ ID NOs:99-102, SEQ ID NO:104, SEQ ID NO:106, SEQ ID NOs:108-111, SEQ ID NO:113, SEQ ID NOs:115-117, SEQ ID NOs:119-122, SEQ ID NOs:124-127, SEQ ID NO:129, SEQ ID NOs:131-134, SEQ ID NOs:136-139, SEQ ID NOs:141-142, SEQ ID NOs:144-147, SEQ ID NO:149, SEQ ID NOs:151-152, SEQ ID NO:154, SEQ ID NO:156, SEQ ID NOs:158-161, SEQ ID NOs:163-169, SEQ ID NO:171, SEQ ID NOs:173-175, SEQ ID NOs:177-181, SEQ ID NOs:183-188, SEQ ID NO:190, SEQ ID NOs:192-198, SEQ ID NOs:200-204, SEQ ID NOs:206-208, SEQ ID NOs:210-216, SEQ ID NOs:218-220, SEQ ID NOs:222-227, SEQ ID NOs:229-243, SEQ ID NOs:245-247, SEQ ID NOs:249-251, SEQ ID NOs:253-264, SEQ ID NOs:266-273, SEQ ID NO:275, SEQ ID NOs:277-279, SEQ ID NOs:281-285, SEQ ID NO:287, SEQ ID NO:289, SEQ ID NOs:291-292, SEQ ID NO:294, SEQ ID NO:296, SEQ ID NOs:298-300, SEQ ID NOs:302-303, SEQ ID NOs:305-307, SEQ ID NOs:309-310, SEQ ID NOs:312-317, SEQ ID NOs:319-320, SEQ ID NO:322, SEQ ID NOs:324-326, SEQ ID NOs:328-329, SEQ ID NO:331, SEQ ID NO:333, SEQ ID NOs:335-339, SEQ ID NOs:341-342, SEQ ID NOs:344-347, SEQ ID NOs:349-353, SEQ ID NOs:355-357, SEQ ID NOs:359-361, SEQ ID NOs:363-366, SEQ ID NOs:368-372, SEQ ID NOs:374-382, SEQ ID NOs:384-389, SEQ ID NOs:391-392, SEQ ID NOs:394-395, SEQ ID NO:397, SEQ ID NOs:399-401, SEQ ID NO:403, SEQ ID NOs:405-406, SEQ ID NOs:408-410, SEQ ID NOs:412-414, SEQ ID NOs:416-422, SEQ ID NOs:424-425, SEQ ID NOs:427-430, SEQ ID NOs:432-434, SEQ ID NOs:436-442, SEQ ID NO:444, SEQ ID NOs:446-449, SEQ ID NO:451, SEQ ID NOs:453-463, SEQ ID NO:465, SEQ ID NOs:467-474, SEQ ID NOs:476-481, SEQ ID NOs:483-486, SEQ ID NOs:488-494, SEQ ID NOs:496-503, SEQ ID NOs:505-507, SEQ ID NOs:509-511, SEQ ID NOs:513-522, SEQ ID NOs:524-538, SEQ ID NOs:540-544, SEQ ID NO:546, SEQ ID NOs:548-552, SEQ ID NOs:554-555, SEQ ID NOs:557-564, SEQ ID NOs:566-574, SEQ ID NOs:576-578, SEQ ID NOs:580-583, SEQ ID NO:585, SEQ ID NO:587, SEQ ID NOs:589-591, SEQ ID NO:593, SEQ ID NO:595, SEQ ID NO:597, SEQ ID NOs:599-602, SEQ ID NOs:604-605, SEQ ID NOs:607-609, SEQ ID NO:611, SEQ ID NOs:613-614, SEQ ID NO:616, SEQ ID NOs:618-620, SEQ ID NO:622, SEQ ID NOs:624-628, SEQ ID NOs:630-634, SEQ ID NOs:636-638, SEQ ID NO:640, SEQ ID NOs:642-644, SEQ ID NOs:646-652, SEQ ID NO:654, SEQ ID NOs:656-658, SEQ ID NOs:660-661, SEQ ID NOs:663-664, SEQ ID NOs:666-669, SEQ ID NOs:671-672, SEQ ID NO:674, SEQ ID NOs:676-677, SEQ ID NO:679, SEQ ID NOs:681-682, SEQ ID NO:684, SEQ ID NO:686, SEQ ID NO:688, SEQ ID NOs:690-691, SEQ ID NOs:693-694, SEQ ID NOs:696-697, SEQ ID NO:699, SEQ ID NO:701, SEQ ID NO:703, SEQ ID NO:705, SEQ ID NOs:707-708, SEQ ID NO:710, SEQ ID NOs:712-722, SEQ ID NO:724, SEQ ID NO:726, SEQ ID NO:728, SEQ ID NOs:730-732, SEQ ID NOs:734-736, SEQ ID NO:738, SEQ ID NO:740, SEQ ID NO:742, SEQ ID NOs:744-746, SEQ ID NO:748, SEQ ID NO:750, SEQ ID NOs:752-754, SEQ ID NOs:756-757, SEQ ID NO:759, SEQ ID NOs:761-766, SEQ ID NO:768, SEQ ID NO:770, SEQ ID NOs:772-797, SEQ ID NO:799, SEQ ID NO:801, SEQ ID NO:803, SEQ ID NO:805, SEQ ID NO:807, SEQ ID NOs:809-813, SEQ ID NOs:815-818, SEQ ID NO:820, SEQ ID NO:822, SEQ ID NO:824, SEQ ID NO:826, SEQ ID NO:828, SEQ ID NO:830, SEQ ID NO:832, SEQ ID NO:834, SEQ ID NO:836, SEQ ID NO:838, SEQ ID NO:840, SEQ ID NOs:842-847, SEQ ID NOs:849-850, SEQ ID NOs:852-853, SEQ ID NO:855, SEQ ID NO:956, or a consensus sequence set forth in any of FIGS. 1-115. In other cases, the nucleic acid encoding the described regulatory protein is contained on a second recombinant nucleic acid construct. In either case, the regulatory region and the regulatory protein are associated, e.g., as indicated in Table 4 (under Example 5) or as described herein (e.g., all orthologs/homologs of a regulatory protein are also considered to associate with the regulatory regions shown to associate with a given regulatory protein in Table 4 under Example 5). A plant cell is typically grown under conditions effective for expression of the regulatory protein.

As will be recognized by those having ordinary skill in the art, knowledge of an associated regulatory region-regulatory protein pair can also be used to modulate expression of endogenous sequences of interest that are operably linked to endogenous regulatory regions. In such cases, a method of modulating expression of a sequence of interest includes transforming a plant cell that includes an endogenous regulatory region as described herein, with a recombinant nucleic acid construct comprising a nucleic acid encoding a regulatory protein as described herein, where the regulatory region and the regulatory protein are associated as indicated in Table 4 (under Example 5) and as described herein. Accordingly, an ortholog/homolog sequence and a polypeptide corresponding to the consensus sequence of a given regulatory protein would also be considered to be associated with the regulatory region indicated in Table 4 (under Example 5) to be associated with the given regulatory protein. A method for expressing an endogenous sequence of interest can include growing such a plant cell under conditions effective for expression of the regulatory protein. An endogenous sequence of interest can in certain cases be a nucleic acid encoding a polypeptide involved in terpenoid biosynthesis, such as a terpenoid biosynthesis enzyme or a regulatory protein involved in terpenoid biosynthesis.

In other cases, knowledge of an associated regulatory region-regulatory protein pair can be used to modulate expression of exogenous sequences of interest by endogenous regulatory proteins. Such a method can include transforming a plant cell that includes a nucleic acid encoding a regulatory protein as described herein, with a recombinant nucleic acid construct comprising a regulatory region described herein, where the regulatory region is operably linked to a sequence of interest, and where the regulatory region and the regulatory protein are associated as shown in Table 4 (under Example 5) and described herein. A method of expressing a sequence of interest can include growing such a plant cell under conditions effective for expression of the endogenous regulatory protein.

Also provided are methods for producing one or more terpenoids. Such a method can include growing a plant cell that includes a nucleic acid encoding an exogenous regulatory protein as described herein and an endogenous regulatory region as described herein operably linked to a sequence of interest. The regulatory protein and regulatory region are associated, as described previously. A sequence of interest can encode a polypeptide involved in terpenoid biosynthesis. A plant cell can be from a plant capable of producing one or more terpenoids. The plant cell can be grown under conditions effective for expression of the regulatory protein. The one or more terpenoids produced can be novel terpenoids, e.g., not normally produced in a wild-type plant cell.

In some cases, a method for producing one or more terpenoids can include growing a plant cell that includes a nucleic acid encoding an endogenous regulatory protein as described herein and a nucleic acid including an exogenous regulatory region as described herein operably linked to a sequence of interest. A sequence of interest can encode a polypeptide involved in terpenoid biosynthesis. A plant cell can be grown under conditions effective for expression of the regulatory protein. The one or more terpenoids produced can be novel terpenoids, e.g., not normally produced in a wild-type plant cell.

Provided herein also are methods for modulating (e.g., altering, increasing, or decreasing) the amounts of one or more terpenoids in a plant cell. The method can include growing a plant cell as described above, e.g., a plant cell that includes a nucleic acid encoding an endogenous or exogenous regulatory protein, where the regulatory protein associates with, respectively, an exogenous or endogenous regulatory region operably linked to a sequence of interest. In such cases, a sequence of interest can encode a polypeptide involved in terpenoid biosynthesis. Alternatively, a sequence of interest can result in a transcription product such as an antisense RNA or interfering RNA that affects terpenoid biosynthesis pathways, e.g., by modulating the steady-state level of mRNA transcripts available for translation that encode one or more terpenoid biosynthesis enzymes.

The invention will be further described in the following examples, which do not limit the scope of the invention described in the claims.

EXAMPLES

Example 1

Generation of *Arabidopsis* Plants Containing Terpenoid Regulatory Region::Luciferase Constructs T-DNA binary vector constructs were made using standard molecular biology techniques. A set of constructs was generated that contained a luciferase coding sequence operably linked to one or two of the regulatory regions set forth in SEQ ID NOs:856-870. Each of these constructs also contained a marker gene conferring resistance to the herbicide Finale®.

Each construct was introduced into *Arabidopsis* ecotype Wassilewskija (WS) by the floral dip method essentially as described in Bechtold et al., *C.R. Acad. Sci. Paris*, 316:1194-1199 (1993). The presence of each reporter region::luciferase construct was verified by PCR. At least two independent events from each transformation, referred to as *Arabidopsis thaliana* screening lines, were selected for further study. $T_1$ (first generation transformant) seeds were germinated and allowed to self-pollinate. $T_2$ (second generation, progeny of self-pollinated $T_1$ plants) seeds were collected and a portion were germinated and allowed to self-pollinate. $T_3$ (third generation, progeny of self-pollinated $T_2$ plants) seeds were collected.

Example 2

Screening of Regulatory Proteins in *Arabidopsis*

$T_2$ or $T_3$ seeds of the *Arabidopsis thaliana* screening lines described in Example 1 were planted in soil comprising Sunshine LP5 Mix and Thermorock Vermiculite Medium #3 at a ratio of 60:40, respectively. The seeds were stratified at 4° C. for approximately two to three days. After stratification, the seeds were transferred to the greenhouse and covered with a plastic dome and tarp until most of the seeds had germinated. Plants were grown under long day conditions. Approximately seven to ten days post-germination, plants were sprayed with Finales herbicide to confirm that the plants were transgenic. Between three to four weeks after germination, the plants were used for screening.

T-DNA binary vector constructs comprising a CaMV 35S promoter operably linked to one of the regulatory protein coding sequences listed in Table 4 (under Example 5) were made and transformed into *Agrobacterium*. One colony from each transformation was selected and maintained as glycerol stock. Two days before the experiment commenced, each transformant was inoculated into 150 µL of YEB broth containing 100 µg/mL spectinomycin, 50 µg/mL rifampicin, and 20 µM acetosyringone; grown in an incubator-shaker at 28° C.; and harvested by centrifugation at 4,000 rpm for at least 25 minutes. The supernatant was discarded, and each pellet was resuspended in a solution of 10 mM MgCl; 10 mM MES, pH 5.7; and 150 µM acetosyringone to an optical density ($OD_{600}$) of approximately 0.05 to 0.1. Each suspension was transferred to a 1 mL syringe outfitted with a 30 gauge needle.

Plants were infected by mildly wounding the surface of a leaf using the tip of a syringe/needle containing a suspension of one of the *Agrobacterium* transformants. A small droplet of the *Agrobacterium* suspension was placed on the wound area after wounding. Each leaf was wounded approximately 10 times at different positions on the same leaf. Each leaf was wounded using one *Agrobacterium* transformant. The syringe needle preferably did not pierce through the leaf to increase the likelihood of *Agrobacterium* infection on the wounded site. Treated leaves were left attached to the mother plant for at least five days prior to analysis.

Example 3

Screening of Regulatory Proteins in *Nicotiana*

Stable *Nicotiana tabacum* screening lines, cultivar Samsun, were generated by transforming *Nicotiana* leaf explants with the T-DNA binary vector constructs containing a luciferase reporter gene operably linked to one or two regulatory regions described in Example 1, following the transformation protocol essentially described by Rogers et al., *Methods in Enzymology*, 118:627 (1987). Leaf disks were cut from leaves of the screening lines using a paper puncher and were transiently infected with *Agrobacterium* clones prepared as described in Example 2. In addition, leaf disks from wild-type *Nicotiana tabacum* plants, cultivar SR1, were transiently infected with *Agrobacterium* containing a binary vector comprising a CaMV 35S promoter operably linked to a luciferase reporter coding sequence. These leaf disks were used as positive controls to indicate that the method of *Agrobacterium* infection was working. Some leaf disks from *Nicotiana* screening plants were transiently infected with *Agrobacterium* containing a binary construct of a CaMV 35S promoter operably linked to a GFP coding sequence. These leaf disks served as reference controls to indicate that the luciferase reporter activity in the treated disks was not merely a response to treatment with *Agrobacterium*.

Transient infection was performed by immersing the leaf disks in about 5 to 10 mL of a suspension of *Agrobacterium* culture, prepared as described in Example 2, for about 2 minutes. Treated leaf disks were briefly and quickly blot-dried in tissue paper and then transferred to a plate lined with paper towels sufficiently wet with 1×MS solution (adjusted to pH 5.7 with 1 N KOH and supplemented with 1 mg/L BAP and 0.25 mg/L NAA). The leaf disks were incubated in a growth chamber under long-day light/dark cycle at 22° C. for five days prior to analysis.

Example 4

Co-Infection Experiments in *Nicotiana*

In some cases, a mixture of two different *Agrobacterium* cultures was used in transient co-infection experiments in wild-type *Nicotiana* plants. One of the *Agrobacterium* cultures contained a vector comprising a regulatory region of interest operably linked to a luciferase reporter gene, and the other contained a vector that included the CaMV 35S promoter operably linked to a nucleotide sequence that coded for a regulatory protein of interest. The *Agrobacterium* culture and suspension were prepared as described in Example 2. The two different *Agrobacterium* suspensions were mixed to a final optical density ($OD_{600}$) of approximately 0.1 to 0.5. The mixture was loaded into a 1 mL syringe with a 30 gauge needle.

Depending on the size of a *Nicotiana* leaf, it can be divided arbitrarily into several sectors, with each sector accommodating one type of *Agrobacterium* mixture. Transient infection of a wild-type tobacco leaf sector was done by mildly wounding the surface of a leaf using the tip of a syringe needle containing a mixture of *Agrobacterium* culture suspensions. A small droplet of the *Agrobacterium* suspension was placed on the wound area after wounding. Each leaf sector was wounded approximately 20 times at different positions within the same leaf sector. Treated *Nicotiana* leaves were left intact and attached to the mother plant for at least five days prior to analysis. A leaf sector treated with *Agrobacterium* that contained a binary construct including a CaMV 35S promoter operably linked to a GFP coding sequence was used as a reference control.

Example 5

Luciferase Assay and Results

Treated intact leaves described in Examples 2 and 4, and leaf disks described in Example 3, were collected five days after infection and placed in a square Petri dish. Each leaf was sprayed with 10 µM luciferin in 0.01% Triton X-100. Leaves were then incubated in the dark for at least one minute prior to imaging with a Night Owl™ CCD camera from Berthold Technology. The exposure time depended on the screening line being tested; in most cases the exposure time was between two and five minutes. Qualitative scoring of luciferase reporter activity from each infected leaf was done by visual inspection and comparison of images, taking into account the following criteria: (1) if the luminescence signal was higher in the treated leaf than in the 35S-GFP-treated reference control (considered the background activity of the regulatory region), and (2) if the first criterion occurred in at least two independent transformation events carrying the regulatory region-luciferase reporter construct. Results of the visual inspection were noted according to the rating system listed in Table 3, and with respect to both the positive and negative controls.

TABLE 3

Luciferase activity scoring system

| Score | Score Comment |
|---|---|
| ++ | signal in the treated leaf is much stronger than in reference background |
| + | signal in the treated leaf is stronger than in reference background |
| +/− | weak signal but still relatively higher than reference background |
| − | no response |

Terpenoid regulatory region/regulatory protein combinations that resulted in a score of +/−, +, or ++ in both independent *Arabidopsis* transformation events were scored as having detectable luciferase reporter activity. Combinations that resulted in a score of +/−, +, or ++ in one independent *Arabidopsis* transformation event were also scored as having detectable reporter activity if similar ratings were observed in the *Nicotiana* experiment. Combinations, also referred to as associations herein, having detectable luciferase reporter activity are shown in Table 4.

TABLE 4

Combinations of regulatory regions and regulatory proteins producing expression of a reporter gene operably linked to each regulatory region

| Regulatory Region Construct | Regulatory Protein SEQ ID NO: | Regulatory Protein Gemini_ID | Regulatory Protein cDNA_ID | Regulatory Protein CLONE_ID | Organism |
|---|---|---|---|---|---|
| AtPEN:K-AtLUP1A:L | 589 | 531F3 | 23359443 | 6568 | *Arabidopsis thaliana* |
| AtBASL:K-AtCPS1:L | 513 | 540H1 | 23666761 | 475689 | *Arabidopsis thaliana* |
| AtDXPS:K-AtDXPR:L | 712 | 531A2 | | | *Arabidopsis thaliana* and Tobacco |
| AtDXPS:K-AtDXPR:L | 663 | 539C6 | | | *Arabidopsis thaliana* |
| AtDXPS:K-AtDXPR:L | 666 | 539G3 | | | *Arabidopsis thaliana* and Tobacco |
| AtDXPS:K-AtDXPR:L | 809 | 539C10 | | | *Arabidopsis thaliana* and Tobacco |
| AtDXPS:K-AtDXPR:L | 676 | 553H9 | | | *Arabidopsis thaliana* and Tobacco |
| AtDXPS:K-AtDXPR:L | 674 | 555G5 | | | *Arabidopsis thaliana* and Tobacco |
| AtDXPS:K-AtDXPR:L | 748 | 539B5 | | | *Arabidopsis thaliana* and Tobacco |
| AtDXPS:K-AtDXPR:L | 770 | 539C3 | | | *Arabidopsis thaliana* and Tobacco |
| AtDXPS:K-AtDXPR:L | 580 | 555A11 | 23366207 | 6066 | *Arabidopsis thaliana* |
| AtDXPS:K-AtDXPR:L | 607 | 555D2 | 23370421 | 8788 | *Arabidopsis thaliana* and Tobacco |
| AtDXPS:K-AtDXPR:L | 151 | 555E5 | 23389866 | 12997 | *Arabidopsis thaliana* and Tobacco |
| AtDXPS:K-AtDXPR:L | 190 | 555E9 | 23462374 | 16209 | *Arabidopsis thaliana* and Tobacco |
| AtDXPS:K-AtDXPR:L | 302 | 535D2 | 23373749 | 27793 | *Arabidopsis thaliana* and Tobacco |
| AtDXPS:K-AtDXPR:L | 331 | 531H4 | 23357293 | 31252 | *Arabidopsis thaliana* and Tobacco |
| AtDXPS:K-AtDXPR:L | 394 | 535B6 | 23368585 | 34060 | *Arabidopsis thaliana* |
| AtDXPS:K-AtDXPR:L | 397 | 555F1 | 23374628 | 34183 | *Arabidopsis thaliana* and Tobacco |
| AtDXPS:K-AtDXPR:L | 399 | 553C4 | 23380594 | 34406 | *Arabidopsis thaliana* and Tobacco |
| AtDXPS:K-AtDXPR:L | 403 | 535F5 | 23369236 | 34589 | *Arabidopsis thaliana* and Tobacco |
| AtDXPS:K-AtDXPR:L | 405 | 536H6 | 23357846 | 35429 | *Arabidopsis thaliana* |
| AtDXPS:K-AtDXPR:L | 416 | 531H5 | 23427841 | 36272 | *Arabidopsis thaliana* and Tobacco |
| AtDXPS:K-AtDXPR:L | 432 | 552B11 | 23361117 | 37792 | *Arabidopsis thaliana* and Tobacco |
| AtDXPS:K-AtDXPR:L | 446 | 554E4 | 23377175 | 38950 | *Arabidopsis thaliana* and Tobacco |
| AtDXPS:K-AtDXPR:L | 476 | 553F6 | 23389429 | 39985 | *Arabidopsis thaliana* |

TABLE 4-continued

Combinations of regulatory regions and regulatory proteins producing expression of a reporter gene operably linked to each regulatory region

| Regulatory Region Construct | Regulatory Protein SEQ ID NO: | Regulatory Protein Gemini_ID | Regulatory Protein cDNA_ID | Regulatory Protein CLONE_ID | Organism |
|---|---|---|---|---|---|
| AtDXPS:K-AtDXPR:L | 488 | 554B2 | 23375627 | 42713 | *Arabidopsis thaliana* |
| AtDXPS:K-AtDXPR:L | 630 | 555D6 | 23363833 | 99519 | *Arabidopsis thaliana* and Tobacco |
| AtDXPS:K-AtDXPR:L | 113 | 555H6 | 23372465 | 106078 | *Arabidopsis thaliana* and Tobacco |
| AtDXPS:K-AtDXPR:L | 115 | 539G6 | 23365210 | 108509 | *Arabidopsis thaliana* and Tobacco |
| AtDXPS:K-AtDXPR:L | 124 | 539B6 | 23370629 | 115924 | *Arabidopsis thaliana* and Tobacco |
| AtDXPS:K-AtDXPR:L | 131 | 533H3 | 23388445 | 117089 | *Arabidopsis thaliana* and Tobacco |
| AtDXPS:K-AtDXPR:L | 141 | 539C7 | 23361365 | 120947 | *Arabidopsis thaliana* and Tobacco |
| AtDXPS:K-AtDXPR:L | 173 | 554B10 | 23376572 | 154718 | *Arabidopsis thaliana* |
| AtDXPS:K-AtDXPR:L | 206 | 539D5 | 23371023 | 207419 | *Arabidopsis thaliana* |
| AtDXPS:K-AtDXPR:L | 222 | 538A5 | 23849426 | 208303 | *Arabidopsis thaliana* |
| AtDXPS:K-AtDXPR:L | 249 | 538E11 | 24331381 | 222894 | *Arabidopsis thaliana* |
| AtDXPS:K-AtDXPR:L | 266 | 552C9 | 23748264 | 225321 | *Arabidopsis thaliana* and Tobacco |
| AtDXPS:K-AtDXPR:L | 275 | 536H8 | 23751937 | 232839 | *Arabidopsis thaliana* |
| AtDXPS:K-AtDXPR:L | 277 | 537B2 | 23768689 | 232985 | *Arabidopsis thaliana* and Tobacco |
| AtDXPS:K-AtDXPR:L | 281 | 537E10 | 23782013 | 237356 | *Arabidopsis thaliana* and Tobacco |
| AtDXPS:K-AtDXPR:L | 289 | 539C4 | 23383853 | 250028 | *Arabidopsis thaliana* and Tobacco |
| AtDXPS:K-AtDXPR:L | 298 | 536A11 | 23748760 | 272716 | *Arabidopsis thaliana* |
| AtDXPS:K-AtDXPR:L | 305 | 555E3 | 23758447 | 283597 | *Arabidopsis thaliana* and Tobacco |
| AtDXPS:K-AtDXPR:L | 324 | 538C4 | 23761786 | 304523 | *Arabidopsis thaliana* and Tobacco |
| AtDXPS:K-AtDXPR:L | 328 | 552G5 | 23765347 | 306497 | *Arabidopsis thaliana* and Tobacco |
| AtDXPS:K-AtDXPR:L | 341 | 552A9 | 23752422 | 319760 | *Arabidopsis thaliana* and Tobacco |
| AtDXPS:K-AtDXPR:L | 344 | 538G10 | 23790410 | 325565 | *Arabidopsis thaliana* |
| AtDXPS:K-AtDXPR:L | 444 | 539G10 | 23808999 | 386908 | *Arabidopsis thaliana* and Tobacco |
| AtDXPS:K-AtDXPR:L | 451 | 539A11 | 23810539 | 389585 | *Arabidopsis thaliana* and Tobacco |
| AtDXPS:K-AtDXPR:L | 548 | 552G2 | 23697027 | 534311 | *Arabidopsis thaliana* and Tobacco |
| AtDXPS:K-AtDXPR:L | 554 | 540E3 | 23692713 | 553603 | *Arabidopsis thaliana* and Tobacco |
| AtDXPS:K-AtDXPR:L | 597 | 553H6 | 23404488 | 691319 | *Arabidopsis thaliana* and Tobacco |

TABLE 4-continued

Combinations of regulatory regions and regulatory proteins producing expression of a reporter gene operably linked to each regulatory region

| Regulatory Region Construct | Regulatory Protein SEQ ID NO: | Regulatory Protein Gemini_ID | Regulatory Protein cDNA_ID | Regulatory Protein CLONE_ID | Organism |
|---|---|---|---|---|---|
| AtDXPS:K-AtDXPR:L | 99 | 5110F2 | 4950532 | | Arabidopsis thaliana and Tobacco |
| AtDXPS:K-AtDXPR:L | 2 | 5110A5 | 13653045 | | Arabidopsis thaliana and Tobacco |
| AtDXPS:K-AtDXPR:L | 12 | 5110C4 | 23486285 | | Arabidopsis thaliana and Tobacco |
| AtDXPS:K-AtDXPR:L | 29 | 5109A2 | 23500965 | | Arabidopsis thaliana |
| AtDXPS:K-AtDXPR:L | 47 | 5110A1 | 23515088 | | Arabidopsis thaliana and Tobacco |
| AtDXPS:K-AtDXPR:L | 53 | 5110H5 | 23522373 | | Arabidopsis thaliana and Tobacco |
| AtDXPS:K-AtDXPR:L | 58 | 5110F11 | 23529806 | | Arabidopsis thaliana |
| AtDXPS:K-AtDXPR:L | 66 | 5110H2 | 23530574 | | Arabidopsis thaliana and Tobacco |
| AtDXPS:K-AtDXPR:L | 69 | 5109B2 | 23538950 | | Arabidopsis thaliana |
| AtDXPS:K-AtDXPR:L | 76 | 5110B1 | 23544992 | | Arabidopsis thaliana and Tobacco |
| AtDXPS:K-AtDXPR:L | 78 | 5109F1 | 23546315 | | Arabidopsis thaliana |
| AtDXPS:K-AtDXPR:L | 84 | 5110A11 | 23629711 | | Arabidopsis thaliana |
| AtDXPS:K-AtDXPR:L | 86 | 5109B7 | 23651543 | | Arabidopsis thaliana |
| AtDXPS:K-AtDXPR:L | 92 | 5109G4 | 24374230 | | Arabidopsis thaliana |
| AtFPPS:L-AtHMGR:L | 728 | 553F5 | | | Arabidopsis thaliana |
| AtFPPS:L-AtHMGR:L | 245 | 553C1 | 23389731 | 21240 | Arabidopsis thaliana and Tobacco |
| AtFPPS:L-AtHMGR:L | 496 | 532F11 | 23374793 | 42960 | Arabidopsis thaliana and Tobacco |
| AtFPPS:L-AtHMGR:L | 171 | 555B2 | 23365920 | 149496 | Arabidopsis thaliana and Tobacco |
| AtFPPS:L-AtHMGR:L | 374 | 538D9 | 23764214 | 336323 | Arabidopsis thaliana and Tobacco |
| AtFPPS:L AtHMGR:L | 384 | 538C9 | 23774709 | 336524 | Arabidopsis thaliana and Tobacco |
| AtFPPS:L-AtHMGR:L | 427 | 539G9 | 23799339 | 374674 | Arabidopsis thaliana and Tobacco |
| AtFPPS:L-AtHMGR:L | 509 | 540E4 | 23662829 | 471089 | Arabidopsis thaliana and Tobacco |
| AtFPPS:L-AtHMGR:L | 546 | 540F5 | 23699071 | 533314 | Arabidopsis thaliana |
| AtFPPS:L-AtHMGR:L | 557 | 553A4 | 23693238 | 556734 | Arabidopsis thaliana and Tobacco |
| AtFPPS:L-AtHMGR:L | 566 | 537C3 | 23382250 | 560681 | Arabidopsis thaliana and Tobacco |
| AtFPPS:L-AtHMGR:L | 14 | 5110C3 | 23492765 | | Arabidopsis thaliana and Tobacco |
| AtGGPS1:K-AtPES:L | 807 | 539D9 | | | Arabidopsis thaliana and Tobacco |

TABLE 4-continued

Combinations of regulatory regions and regulatory proteins producing expression of a reporter gene operably linked to each regulatory region

| Regulatory Region Construct | Regulatory Protein SEQ ID NO: | Regulatory Protein Gemini_ID | Regulatory Protein cDNA_ID | Regulatory Protein CLONE_ID | Organism |
|---|---|---|---|---|---|
| AtGGPS1:K-AtPES:L | 752 | 539G2 | | | *Arabidopsis thaliana* |
| AtGGPS1:K-AtPES:L | 849 | 5109D10 | | | *Arabidopsis thaliana* and Tobacco |
| AtGGPS1:K-AtPES:L | 642 | 553B5 | | | *Arabidopsis thaliana* and Tobacco |
| AtGGPS1:K-AtPES:L | 742 | 539H5 | | | *Arabidopsis thaliana* and Tobacco |
| AtGGPS1:K-AtPES:L | 840 | 5109B6 | | | *Arabidopsis thaliana* and Tobacco |
| AtGGPS1:K-AtPES:L | 106 | 532G1 | 23383956 | 7201 | *Arabidopsis thaliana* and Tobacco |
| AtGGPS1:K-AtPES:L | 108 | 532H1 | 23388050 | 10375 | *Arabidopsis thaliana* and Tobacco |
| AtGGPS1:K-AtPES:L | 496 | 532F1 | 23375846 | 92102 | *Arabidopsis thaliana* |
| AtGGPS1:K-AtPES:L | 141 | 539C7 | 23361365 | 120947 | *Arabidopsis thaliana* |
| AtGGPS1:K-AtPES:L | 144 | 532D4 | 23449548 | 123905 | *Arabidopsis thaliana* |
| AtGGPS1:K-AtPES:L | 149 | 539G7 | 23365512 | 125922 | *Arabidopsis thaliana* and Tobacco |
| AtGGPS1:K-AtPES:L | 222 | 538A5 | 23849426 | 208303 | *Arabidopsis thaliana* and Tobacco |
| AtGGPS1:K-AtPES:L | 333 | 538E5 | 23767585 | 316638 | *Arabidopsis thaliana* and Tobacco |
| AtGGPS1:K-AtPES:L | 344 | 538G10 | 23790410 | 325565 | *Arabidopsis thaliana* |
| AtGGPS1:K-AtPES:L | 349 | 538H4 | 23765288 | 331626 | *Arabidopsis thaliana* and Tobacco |
| AtGGPS1:K-AtPES:L | 391 | 538H7 | 23767148 | 336888 | *Arabidopsis thaliana* |
| AtGGPS1:K-AtPES:L | 576 | 537H2 | 23391578 | 560731 | *Arabidopsis thaliana* and Tobacco |
| AtGGPS1:K-AtPES:L | 618 | 553C6 | 23419225 | 968026 | *Arabidopsis thaliana* and Tobacco |
| AtGGPS1:K-AtPES:L | 99 | 5110F2 | 4950532 | | *Arabidopsis thaliana* |
| AtGGPS1:K-AtPES:L | 4 | 5109H11 | 23381275 | | *Arabidopsis thaliana* and Tobacco |
| AtGGPS1:K-AtPES:L | 6 | 5111C1 | 23480178 | | *Arabidopsis thaliana* |
| AtGGPS1:K-AtPES:L | 22 | 5109C2 | 23497949 | | *Arabidopsis thaliana* and Tobacco |
| AtGGPS1:K-AtPES:L | 27 | 5109F10 | 23499985 | | *Arabidopsis thaliana* and Tobacco |
| AtGGPS1:K-AtPES:L | 39 | 5110A8 | 23503138 | | *Arabidopsis thaliana* and Tobacco |
| AtGGPS1:K-AtPES:L | 45 | 5111A1 | 23512013 | | *Arabidopsis thaliana* |
| AtGGPS1:K-AtPES:L | 51 | 5109G12 | 23521525 | | *Arabidopsis thaliana* and Tobacco |
| AtGGPS1:K-AtPES:L | 73 | 5109C3 | 23544687 | | *Arabidopsis thaliana* |

TABLE 4-continued

Combinations of regulatory regions and regulatory proteins producing expression of a reporter gene operably linked to each regulatory region

| Regulatory Region Construct | Regulatory Protein SEQ ID NO: | Regulatory Protein Gemini_ID | Regulatory Protein cDNA_ID | Regulatory Protein CLONE_ID | Organism |
|---|---|---|---|---|---|
| AtGGPS1:K-AtPES:L | 88 | 5109C6 | 23653450 | | *Arabidopsis thaliana* and Tobacco |
| AtGPPS:K-AtTPS3:L | 505 | 533E11 | 23389169 | 45 | *Arabidopsis thaliana* |
| AtGPPS:K-AtTPS3:L | 467 | 533D10 | 24418108 | 3997 | *Arabidopsis thaliana* |
| AtGPPS:K-AtTPS3:L | 616 | 554E1 | 23358998 | 9552 | *Arabidopsis thaliana* and Tobacco |
| AtGPPS:K-AtTPS3:L | 119 | 532C11 | 23364997 | 11130 | *Arabidopsis thaliana* |
| AtGPPS:K-AtTPS3:L | 163 | 532D11 | 23657254 | 14246 | *Arabidopsis thaliana* and Tobacco |
| AtGPPS:K-AtTPS3:L | 183 | 531H7 | 23358452 | 16204 | *Arabidopsis thaliana* and Tobacco |
| AtGPPS:K-AtTPS3:L | 229 | 531F7 | 23386664 | 21075 | *Arabidopsis thaliana* and Tobacco |
| AtGPPS:K-AtTPS3:L | 291 | 554G8 | 23362339 | 25795 | *Arabidopsis thaliana* and Tobacco |
| AtGPPS:K-AtTPS3:L | 312 | 533E12 | 24418089 | 29310 | *Arabidopsis thaliana* and Tobacco |
| AtGPPS:K-AtTPS3:L | 424 | 532E8 | 23386077 | 36927 | *Arabidopsis thaliana* |
| AtGPPS:K-AtTPS3:L | 184 | 531C1 | 23448005 | 98140 | *Arabidopsis thaliana* and Tobacco |
| AtGPPS:K-AtTPS3:L | 106 | 532G12 | 23462890 | 103581 | *Arabidopsis thaliana* |
| AtGPPS:K-AtTPS3:L | 129 | 554G12 | 23374523 | 116843 | *Arabidopsis thaliana* and Tobacco |
| AtGPPS:K-AtTPS3:L | 136 | 554C9 | 23376381 | 119104 | *Arabidopsis thaliana* and Tobacco |
| AtGPPS:K-AtTPS3:L | 156 | 532G10 | 23360987 | 141875 | *Arabidopsis thaliana* and Tobacco |
| AtGPPS:K-AtTPS3:L | 210 | 531C2 | 23389444 | 207629 | *Arabidopsis thaliana* and Tobacco |
| AtGPPS:K-AtTPS3:L | 294 | 539H4 | 23383652 | 261609 | *Arabidopsis thaliana* and Tobacco |
| AtGPPS:K-AtTPS3:L | 309 | 538H2 | 23779979 | 286402 | *Arabidopsis thaliana* and Tobacco |
| AtGPPS:K-AtTPS3:L | 328 | 552G5 | 23765347 | 306497 | *Arabidopsis thaliana* and Tobacco |
| AtGPPS:K-AtTPS3:L | 355 | 538H6 | 23767681 | 333416 | *Arabidopsis thaliana* and Tobacco |
| AtGPPS:K-AtTPS3:L | 363 | 538F7 | 23768333 | 335011 | *Arabidopsis thaliana* and Tobacco |
| AtGPPS:K-AtTPS3:L | 465 | 539C11 | 23809886 | 393033 | *Arabidopsis thaliana* and Tobacco o |
| AtGPPS:K-AtTPS3:L | 524 | 540C2 | 23664396 | 481710 | *Arabidopsis thaliana* and Tobacco |
| AtGPPS:K-AtTPS3:L | 540 | 540D6 | 23675593 | 481915 | *Arabidopsis thaliana* |
| AtGPPS:K-AtTPS3:L | 593 | 553H5 | 23704291 | 660003 | *Arabidopsis thaliana* and Tobacco |

TABLE 4-continued

Combinations of regulatory regions and regulatory proteins producing
expression of a reporter gene operably linked to each regulatory region

| Regulatory Region Construct | Regulatory Protein SEQ ID NO: | Regulatory Protein Gemini_ID | Regulatory Protein cDNA_ID | Regulatory Protein CLONE_ID | Organism |
|---|---|---|---|---|---|
| AtGPPS:K-AtTPS3:L | 613 | 537E8 | 23420635 | 955048 | *Arabidopsis thaliana* and Tobacco |
| AtHMGR:K-AtHMGS:L | 730 | 539C8 | | | *Arabidopsis thaliana* and Tobacco |
| AtHMGR:K-AtHMGS:L | 682 | 531D2 | | | *Arabidopsis thaliana* and Tobacco |
| AtHMGR:K-AtHMGS:L | 636 | 535D3 | | | *Arabidopsis thaliana* and Tobacco |
| AtHMGR:K-AtHMGS:L | 761 | 538C5 | | | *Arabidopsis thaliana* and Tobacco |
| AtHMGR:K-AtHMGS:L | 772 | 531F2 | | | *Arabidopsis thaliana* and Tobacco |
| AtHMGR:K-AtHMGS:L | 656 | 531F4 | | | *Arabidopsis thaliana* and Tobacco |
| AtHMGR:K-AtHMGS:L | 836 | 5110F6 | | | *Arabidopsis thaliana* and Tobacco |
| AtHMGR:K-AtHMGS:L | 855 | 5109A11 | | | *Arabidopsis thaliana* and Tobacco |
| AtHMGR:K-AtHMGS:L | 585 | 553B10 | 23368314 | 6163 | *Arabidopsis thaliana* and Tobacco |
| AtHMGR:K-AtHMGS:L | 604 | 531D8 | 23366147 | 7805 | *Arabidopsis thaliana* and Tobacco |
| AtHMGR:K-AtHMGS:L | 154 | 535G10 | 23369276 | 13930 | *Arabidopsis thaliana* and Tobacco |
| AtHMGR:K-AtHMGS:L | 158 | 535F2 | 23367680 | 14234 | *Arabidopsis thaliana* and Tobacco |
| AtHMGR:K-AtHMGS:L | 192 | 535H8 | 23374596 | 17632 | *Arabidopsis thaliana* |
| AtHMGR:K-AtHMGS:L | 200 | 552A11 | 23358277 | 19340 | *Arabidopsis thaliana* and Tobacco |
| AtHMGR:K-AtHMGS:L | 253 | 535A11 | 23368521 | 22339 | *Arabidopsis thaliana* |
| AtHMGR:K-AtHMGS:L | 296 | 535B8 | 23390265 | 26867 | *Arabidopsis thaliana* and Tobacco |
| AtHMGR:K-AtHMGS:L | 319 | 553C3 | 23366647 | 29637 | *Arabidopsis thaliana* and Tobacco |
| AtHMGR:K-AtHMGS:L | 335 | 535C8 | 23358176 | 31894 | *Arabidopsis thaliana* and Tobacco |
| AtHMGR:K-AtHMGS:L | 408 | 534B6 | 23381009 | 35786 | *Arabidopsis thaliana* and Tobacco |
| AtHMGR:K-AtHMGS:L | 436 | 531C6 | 23357492 | 38311 | *Arabidopsis thaliana* and Tobacco |
| AtHMGR:K-AtHMGS:L | 446 | 554E4 | 23377175 | 38950 | *Arabidopsis thaliana* |
| AtHMGR:K-AtHMGS:L | 453 | 535C7 | 23362522 | 39279 | *Arabidopsis thaliana* and Tobacco |
| AtHMGR:K-AtHMGS:L | 185 | 531C1 | 23448005 | 98140 | *Arabidopsis thaliana* and Tobacco |
| AtHMGR:K-AtHMGS:L | 624 | 554G11 | 23372744 | 99075 | *Arabidopsis thaliana* and Tobacco |

TABLE 4-continued

Combinations of regulatory regions and regulatory proteins producing expression of a reporter gene operably linked to each regulatory region

| Regulatory Region Construct | Regulatory Protein SEQ ID NO: | Regulatory Protein Gemini_ID | Regulatory Protein cDNA_ID | Regulatory Protein CLONE_ID | Organism |
|---|---|---|---|---|---|
| AtHMGR:K-AtHMGS:L | 104 | 539F6 | 23364710 | 100085 | *Arabidopsis thaliana* |
| AtHMGR:K-AtHMGS:L | 177 | 554G10 | 23514168 | 158155 | *Arabidopsis thaliana* and Tobacco |
| AtHMGR:K-AtHMGS:L | 249 | 538E11 | 24331381 | 222894 | *Arabidopsis thaliana* |
| AtHMGR:K-AtHMGS:L | 287 | 552B6 | 23773450 | 241491 | *Arabidopsis thaliana* and Tobacco |
| AtHMGR:K-AtHMGS:L | 322 | 536B10 | 23761769 | 303140 | *Arabidopsis thaliana* |
| AtHMGR:K-AtHMGS:L | 359 | 538C6 | 24385563 | 333753 | *Arabidopsis thaliana* and Tobacco |
| AtHMGR:K-AtHMGS:L | 368 | 538D8 | 23778718 | 335471 | *Arabidopsis thaliana* and Tobacco |
| AtHMGR:K-AtHMGS:L | 412 | 538E12 | 23796210 | 362309 | *Arabidopsis thaliana* and Tobacco |
| AtHMGR:K-AtHMGS:L | 587 | 531A12 | 23701264 | 625627 | *Arabidopsis thaliana* and Tobacco |
| AtHMGR:K-AtHMGS:L | 595 | 555C4 | 23704869 | 674157 | *Arabidopsis thaliana* and Tobacco |
| AtHMGR:K-AtHMGS:L | 622 | 552G6 | 23419038 | 969750 | *Arabidopsis thaliana* and Tobacco |
| AtHMGR:K-AtHMGS:L | 97 | 5110B6 | 2999012 | | *Arabidopsis thaliana* |
| AtHMGR:K-AtHMGS:L | 19 | 5109D9 | 23495742 | | *Arabidopsis thaliana* and Tobacco |
| AtHMGR:K-AtHMGS:L | 36 | 5110C11 | 23500996 | | *Arabidopsis thaliana* and Tobacco |
| AtHMGR:K-AtHMGS:L | 41 | 5109C9 | 23503813 | | *Arabidopsis thaliana* and Tobacco |
| AtHMGR:K-AtHMGS:L | 43 | 5110E3 | 23509939 | | *Arabidopsis thaliana* and Tobacco |
| AtHMGR:K-AtHMGS:L | 71 | 5110D6 | 23544617 | | *Arabidopsis thaliana* and Tobacco |
| AtHMGR:K-AtHMGS:L | 80 | 5111B1 | 23557940 | | *Arabidopsis thaliana* |
| AtSREBP:K-AtSQS1:L | 218 | 534G9 | 23556763 | 20769 | *Arabidopsis thaliana* and Tobacco |
| AtSREBP:K-AtSQS1:L | 331 | 531H4 | 23357293 | 31252 | *Arabidopsis thaliana* and Tobacco |
| AtSREBP:K-AtSQS1:L | 483 | 554H7 | 23535342 | 40736 | *Arabidopsis thaliana* and Tobacco |
| AtSREBP:K-AtSQS1:L | 690 | 531E5 | | | *Arabidopsis thaliana* and Tobacco |
| AtSREBP:K-AtSQS1:L | 407 | 555D4 | | | *Arabidopsis thaliana* and Tobacco |
| AtSREBP:K-AtSQS1:L | 45 | 5111A1 | 23512013 | | *Arabidopsis thaliana* |
| AtGGPS1:L-AtDXPS:L | 699 | 535A8 | | 35890 | *Arabidopsis thaliana* |
| AtGGPS1:L-AtDXPS:L | 738 | 533A6 | | 117953 | *Arabidopsis thaliana* |
| AtGGPS1:L-AtDXPS:L | 830 | 552G10 | | 601862 | *Arabidopsis thaliana* |

TABLE 4-continued

Combinations of regulatory regions and regulatory proteins producing expression of a reporter gene operably linked to each regulatory region

| Regulatory Region Construct | Regulatory Protein SEQ ID NO: | Regulatory Protein Gemini_ID | Regulatory Protein cDNA_ID | Regulatory Protein CLONE_ID | Organism |
|---|---|---|---|---|---|
| AtGGPS1:L-AtDXPS:L | 684 | 533C5 | | 27175 | Arabidopsis thaliana |
| AtGGPS1:L-AtDXPS:L | 710 | 535A7 | | 42533 | Arabidopsis thaliana |
| AtGGPS1:L-AtDXPS:L | 740 | 533B6 | | 143475 | Arabidopsis thaliana |
| AtGGPS1:L-AtDXPS:L | 768 | 555G8 | | 248061 | Arabidopsis thaliana |
| AtGGPS1:L-AtDXPS:L | 686 | 553D4 | | 33016 | Arabidopsis thaliana |
| AtGGPS1:L-AtDXPS:L | 834 | 552H1 | | 982774 | Arabidopsis thaliana |
| AtGGPS1:L-AtDXPS:L | 206 | 539D5 | | 207419 | Arabidopsis thaliana |
| AtGGPS1:L-AtDXPS:L | 824 | 552H7 | | 560898 | Arabidopsis thaliana |
| AtGGPS1:L-AtDXPS:L | 828 | 5109D4 | | | Arabidopsis thaliana |
| AtGGPS1:L-AtDXPS:L | 832 | 5110C1 | | | Arabidopsis thaliana |
| AtGGPS1:L-AtDXPS:L | 687 | 532E7 | | 34363 | Arabidopsis thaliana |
| AtGGPS1:L-AtDXPS:L | 640 | 534F8 | | 4346 | Arabidopsis thaliana |
| AtGGPS1:L-AtDXPS:L | 724 | 534G7 | | 97474 | Arabidopsis thaliana |
| AtGGPS1:L-AtDXPS:L | 679 | 536C7 | | 23733 | Arabidopsis thaliana |
| AtGGPS1:L-AtDXPS:L | 726 | 536H5 | | 101603 | Arabidopsis thaliana |
| AtGGPS1:L-AtDXPS:L | 805 | 538A10 | | 343205 | Arabidopsis thaliana |
| AtGGPS1:L-AtDXPS:L | 801 | 538B7 | | 333618 | Arabidopsis thaliana |
| AtGGPS1:L-AtDXPS:L | 803 | 538H7 | | 336888 | Arabidopsis thaliana |
| AtGGPS1:L-AtDXPS:L | 820 | 540E9 | | 473126 | Arabidopsis thaliana |
| AtGGPS1:L-AtDXPS:L | 822 | 540H9 | | 546496 | Arabidopsis thaliana |
| AtGGPS1:L-AtDXPS:L | 826 | 552F3 | | 566161 | Arabidopsis thaliana |
| AtGGPS1:L-AtDXPS:L | 799 | 552H9 | | 284030 | Arabidopsis thaliana |
| AtGGPS1:L-AtDXPS:L | 701 | 554F7 | | 36399 | Arabidopsis thaliana |
| AtGGPS1:L-AtDXPS:L | 703 | 554G7 | | 37859 | Arabidopsis thaliana |
| AtGGPS1:L-AtDXPS:L | 750 | 555D11 | | 159557 | Arabidopsis thaliana |

L = Luciferase
K = Kanamycin (neomycin phosphotransferase)
AtPEN = *Arabidopsis* pentacyclic synthase
AtLUP1A = *Arabidopsis* Lupeol synthase 1A
AtBASL = *Arabidopsis* Beta-Amyrin synthase like
AtCPS1 = *Arabidopsis* ent-copalyl pyrophosphate synthase
AtDXPS = *Arabidopsis* deoxyxylulosephosphate synthase
AtDXPR = *Arabidopsis* deoxyxylulosephosphate reductoisomerase
AtFPPS = *Arabidopsis* farnesylpyrophosphate synthase
AtGGPS1 = *Arabidopsis* geranylgeranylpyrophosphate synthase 1
AtPES = *Arabidopsis* phytoene synthase
AtGPPS = *Arabidopsis* geranylpyrophosphate synthase
AtTPS3 = *Arabidopsis* terpene synthase 3
AtHMGR = *Arabidopsis* hydroxymethyl glutaryl CoA reductase
AtHMGS = *Arabidopsis* hydroxymethyl glutaryl CoA synthase
AtSREBP = *Arabidopsis* sterol responsive element binding protein
AtSQS1 = *Arabidopsis* squalene synthase 1

Example 6

Analysis of Transgenic Tomatoes for Carotenoids, Phytosterols, and Tocopherols Transgenic tomato plants were generated using the Microtom variety as the recipient line. Each transgenic plant line contained a construct comprising a CaMV 35S promoter operably linked to one of the regulatory protein coding sequences listed in Table 5.

Explants of cotyledons from seven to nine day old seedlings were transformed using an *Agrobacterium*-mediated transformation method essentially as described in Park et al., *J. Plant Physiol.*, 160:1253-1257 (2003). Transformants were selected using a bialophos resistance gene as a selectable marker and selecting on a bialophos containing medium. After selection for transformed tissues, plants were regenerated in a greenhouse and fruit tissues were analyzed for carotenoids, phytosterols, and tocopherols.

Tomato fruits were quartered, frozen in liquid nitrogen, and lyophilized for seven days. The lyophilized tissue was ground into a fine powder, and 30 mg±3 mg of ground tissue were extracted with 1.50 mL of a 4:3 mixture of ethanol and hexane containing 0.05% w/v butylatedhydroxy toluene. Sixty µL of a solution containing 1 µg/µL of trans-crocetin in ethanol was added as an internal standard. The mixture was mixed by inversion on an orbital shaker for 45 minutes at 4° C. in the dark. Care was taken not to expose the extract to heat or light. The extract was decanted into a syringe and filtered through a 0.22 micron filter into an amber LC-MS vial. The extract was analyzed for carotenoid content using a Waters 2795 Alliance system with a 996 PDA Detector, a Micromass ZMD single quadrupole mass spectrometer, and an atmospheric pressure chemical ionization probe (Waters Corp., Milford, Mass.). Separation of molecules was accomplished using a Luna $C_{18}(2)$ 4.6×150 mm column (Phenomenex, Torrance, Calif.). Carotenoid compounds were identified based on spectral characteristics and comparison to reference standards and published retention times.

To analyze phytosterol and tocopherol contents, 30 mg±3 mg of ground tissue per sample were placed into a 2 mL Eppendorf tube, and 1.25 mL of ethyl acetate were added to the tube along with 20 µL of a solution containing 1 mg/mL of 19-OH cholesterol in ethyl acetate. The samples were incubated at 70° C. in a heat block for 30 minutes, during which time they were vortexed every five minutes for ten seconds. The samples were then centrifuged at 14,000 g for five minutes, and the extracts were transferred to a 1.5 mL autosampler vial and dried in a Savant SpeedVac for three hours using cryovac pumping. Each dried extract was resuspended in 80 µL of pyridine, sonicated to ensure complete resuspension of the crystals, and incubated for 90 minutes at 25° C. while shaking continuously. After adding 120 µL of MSTFA (Sigma-Aldrich, Saint Louis, Mo.) to each sample, the samples were incubated at 37° C. for 30 minutes and then at room temperature for 120 minutes. Each sample was analyzed for phytosterol and tocopherol content using a QP-2010 GC-MS instrument (Shimadzu Scientific Instruments, Columbia, Md.) with a Varian FactorFour™ column (30 m×0.25 mm×0.25 µm film thickness with 10 m integrated guard column; Varian, Inc., Palo Alto, Calif.). Data were analyzed using the Shimadzu GC-MS Solutions program. Phytosterols and tocopherols were identified by means of retention time standards and mass spectral libraries. Target peak areas were integrated and normalized with respect to the internal standard and the initial weight of the sample. The experimental samples were normalized with respect to the control to obtain normalized response factors. Calibration curves were used for absolute quantitation.

Results of the analyses of tomato fruit for carotenoid, phytosterol, and/or tocopherol contents are presented in Table 5.

TABLE 5

Modulation of carotenoid, phytosterol, and/or tocopherol levels in tomatoes transformed with a regulatory protein

| Regulatory Protein Gemini ID | Regulatory Protein cDNA ID | Regulatory Protein Clone ID | Regulatory protein SEQ ID NO: | # of Events Modulated/ # of Events Tested | Fold-Increase or Decrease[1] |
|---|---|---|---|---|---|
| 531A2 | | | 712 | 1/5 | 2X increase in Lutein |
| 539C6 | | | 663 | 1/1 | No change |
| 539G3 | | | 666 | 1/4 | 3X increase in Lutein |
| | | | | 1/4 | 2X increase in β-Carotene |
| 539C10 | | | 809 | 1/1 | No change |
| 553H9 | | | 676 | 4/4 | 1.3-1.8X increase in Lutein |
| 555G5 | | | 674 | 3/3 | Decrease in ζ-Carotene |
| 539B5 | | | 748 | 4/6 | 2-3X increase in Lycopene |
| 539C3 | | | 770 | 1/5 | 2X increase in Cycloartenol |
| | | | | 2/5 | 1.5X increase in Lupeol |
| | | | | 1/5 | 2X increase in Campesterol |
| | | | | 1/5 | 1.8X increase in β-Amyrin & slight increase in Campesterol |
| | | | | 1/5 | 2X increase in Triterpenes[3] and decrease in Campesterol |
| 555D2 | 23370421 | 8788 | 607 | 1/3 | 1.8X increase in Lutein |
| | | | | 3/3 | 3-4X increase in ζ-carotene |
| 535F5 | 23369236 | 34589 | 403 | 6/8 | Decrease in carotenoids[4] |
| 554B2 | 23375627 | 42713 | 488 | 2/9 | 1.2-1.3X increase in Lycopene |
| | | | | 2/9 | Slight increase in Lutein & Zeaxanthin |
| | | | | 2/9 | Increase in β-Carotene |
| | | | | 1/9 | 2X increase in ζ-Carotene |
| 539C7 | 23361365 | 120947 | 141 | 2/2 | No change |
| 538E11 | 24331381 | 222894 | 249 | 2/5 | 2X increase in β-Carotene |
| | | | | 1/5 | 1.3X increase in Lycopene |
| 5109G4 | 24374230 | | 92 | 2/5 | 2X increase in Lutein |
| | | | | 1/5 | 2X increase in β-Carotene |
| | | | | 3/5 | 2X increase in δ-Carotene |
| | | | | 1/5 | Decrease in Lutein & β-Carotene |

TABLE 5-continued

Modulation of carotenoid, phytosterol, and/or tocopherol levels in tomatoes transformed with a regulatory protein

| Regulatory Protein Gemini ID | Regulatory Protein cDNA ID | Regulatory Protein Clone ID | Regulatory protein SEQ ID NO: | # of Events Modulated/ # of Events Tested | Fold-Increase or Decrease[1] |
|---|---|---|---|---|---|
| 553F5 | | | 728 | 2/3 | 3X increase in β/α-Amyrin |
| 553C1 | 23389731 | 21240 | 245 | 3/3 | 3X increase in β/α-Amyrin |
| 532F11 | 23374793 | 42960 | 496 | 7/9 | 2X increase in Cycloartenol |
| | | | | 7/9 | 2X increase in Lupeol |
| | | | | 7/9 | 2X increase in α-Amyrin |
| | | | | 4/9 | Decrease in Squalene |
| | | | | 1/9 | 2X increase in Stigmasterol |
| 555B2 | 23365920 | 149496 | 171 | 1/4 | 2-3X increase in Triterpenes[3] |
| 538D9 | 23764214 | 336323 | 374 | 2/6 | 1.5-3X increase in Phytosterols[5] |
| | | | | 1/6 | 2X increase in Squalene |
| | | | | 1/6 | 1.6X increase in β-Sitosterol |
| | | | | 2/6 | Decrease in Squalene |
| 537C3 | 23382250 | 560681 | 566 | 1/4 | 2X increase in Squalene |
| | | | | 1/4 | 2X increase in Stigmasterol |
| | | | | 1/4 | 2X increase in Lupeol |
| | | | | 2/4 | 1.5-2X increase in Cycloartenol |
| | | | | 1/4 | 2X increase in β/α-Amyrin |
| 539D9 | | | 807 | 4/4 | No change |
| 539G2 | | | 752 | 6/6 | No change |
| 5109D10 | | | 849 | 1/7 | 2X increase in δ-Carotene |
| 553B5 | | | 642 | 1/6 | 2X increase in Lutein |
| | | | | 1/6 | 2X increase in β-Carotene |
| | | | | 1/6 | 2X increase in δ-Carotene |
| | | | | 1/6 | 2X increase in ζ-Carotene |
| 539H5 | | | 742 | 4/6 | 2-2.5X increase in Lycopene |
| | | | | 1/6 | Decrease in Lutein & ζ-Carotene |
| 5109B6 | | | 840 | 3/4 | Decrease in ζ-Carotene |
| | | | | 3/4 | Increase in unknown molecule (m/z = 541.7) |
| 532G1 | 23383956 | 7201 | 599 | 6/8 | 2-5X increase in β-Carotene New Peak in chromatogram |
| 539G7 | 23365512 | 125922 | 149 | 4/6 | 3-7X increase in ζ-Carotene |
| | | | | 1/6 | 2X increase in δ-Carotene |
| 538E5 | 23767585 | 316638 | 333 | 2/3 | 2X increase in β-Carotene |
| | | | | 1/3 | 2X increase in Lycopene |
| 553C6 | 23419225 | 968026 | 618 | 3/10 | 2-4X increase in ζ-Carotene |
| | | | | 1/10 | Decrease in lycopene & carotenes[6] |
| 5109C6 | 23653450 | | 88 | 2/3 | Decrease in ζ-carotene |
| | | | | 1/3 | Decrease in all Carotenoids[4] |
| 531C1 | 23448005 | 98140 | 185 | 2/5 | 2X increase in Squalene |
| | | | | 1/5 | 2X increase in Phytosterols[5] |
| | | | | 1/5 | 2X increase in Tocopherols[7] |
| | | | | 1/5[2] | 2X increase in β-sitosterol |
| 539C8 | | | 730 | 2/8[2] | 2-3.5X increase in Squalene, Triterpenes[3], & Phytosterols[5] |
| 531D2 | | | 681 | 3/4 | 2-3X increase in Campesterol, Stigmasterol, & Sitosterol |
| | | | | 3/4 | Decrease in Squalene |
| | | | | 1/4 | 2X increase in Stigmasterol |
| 535D3 | | | 636 | 2/6 | Decrease in β/α-Amyrin |
| | | | | 3/6 | 1.5-2X increase in Phytosterols[5] |
| | | | | 1/6 | 2X increase in Squalene |
| 538C5 | | | 761 | 4/5 | 2X increase in β-Amyrin |
| | | | | 4/5 | Decrease in Phytosterols[5] |
| 531F2 | | | 772 | 1/2 | 2X increase in β-Amyrin |
| | | | | 1/2 | Decrease in Phytosterols[5] |
| 531F4 | | | 656 | 3/4 | 2-3X increase in Triterpenes[3] |
| | | | | 1/4 | 2X increase in Phytosterols[5] & increase in Triterpenes[3] |
| 5110F6 | | | 836 | 2/3 | 2X increase in Phytosterols[5] |
| | | | | 2/3 | 2X increase in Triterpenes[3] |
| | | | | 2/3 | 2X increase in Tocopherols[7] |
| 5109A11 | | | 855 | 2/10 | 1.4-2X increase in Stigmasterol |
| | | | | 3/10 | 1.3-2X increase in Sitosterol |
| | | | | 2/10 | 1.8-2X increase in β-Amyrin |
| | | | | 3/10 | 2X increase in Lupeol |
| | | | | 3/10 | 1.8-2X increase in Campesterol |
| | | | | 2/10 | 2X increase in α-Amyrin |
| 535G10 | 23369276 | 13930 | 154 | 6/9 | 2-7X increase in all Tocopherols[7] |
| | | | | 2/9 | 2X increase in Phytosterols[5] |
| | | | | 2/9 | 2X increase in Triterpenes[3] |
| | | | | 1/9 | 2X increase in β-Amyrin |

TABLE 5-continued

Modulation of carotenoid, phytosterol, and/or tocopherol levels in tomatoes transformed with a regulatory protein

| Regulatory Protein Gemini ID | Regulatory Protein cDNA ID | Regulatory Protein Clone ID | Regulatory protein SEQ ID NO: | # of Events Modulated/ # of Events Tested | Fold-Increase or Decrease[1] |
|---|---|---|---|---|---|
| | | | | 1/9 | 2X increase in Stigmasterol |
| | | | | 1/9 | 15X increase in Squalene |
| | | | | 1/9 | Decrease in Triterpenes[3] & Phytosterols[5] |
| 534B6 | 23381009 | 35786 | 408 | 3/4 | 2X increase in β-Amyrin |
| | | | | 1/4 | 2X increase in Squalene |
| 552B6 | 23773450 | 241491 | 287 | 2/5 | 2-7X increase in Squalene |
| | | | | 4/5 | 2-4X increase in Triterpenes[3] |
| 536B10 | 23761769 | 303140 | 322 | 2/2 | No change |
| 538D8 | 23778718 | 335471 | 368 | 4/6 | 1.2-3X increase in Triterpenes[3] |
| | | | | 2/6 | 1.5-2X increase in Stigmasterol |
| | | | | 5/6 | 1.3-3X increase in Tocopherols[7] |
| 538E12 | 23796210 | 362309 | 412 | 2/5 | 3X increase in Squalene |
| | | | | 2/5 | 2X increase in Triterpenes[3] |
| | | | | 2/5 | 2X increase in Phytosterols[5] |
| 531A12 | 23701264 | 625627 | 587 | 2/4[2] | 1.5-2X increase in squalene |
| | | | | 2/4 | Decrease in Phytosterols[5] |
| | | | | 1/4 | 2X increase in Tocopherols[7] |
| 5109D9 | 23495742 | | 19 | 3/3 | Decrease in Squalene |
| | | | | 3/3 | Decrease in Phytosterols[5] |
| | | | | 3/3 | Increase in Triterpenes[3] |
| 5110C11 | 23500996 | | 36 | 4/4 | 2-4X increase in Triterpenes[3] |
| 5109C9 | 23503813 | | 41 | 1/3 | 2X increase in Phytosterols[5] |
| | | | | 2/3 | 2X increase in Triterpenes[3] |
| 534G9 | 23556763 | 20769 | 218 | 2/7 | 2X increase in Amyrin, Lupeol, & Cycloartenol |
| | | | | 2/7 | Increase in Triterpenes[3] |
| | | | | 2/7 | Decrease in Phytosterols[5] |
| 531H4 | 23357293 | 31252 | 331 | 3/6[2] | 1.3-1.5X increase in α-Amyrin, Cycloartenol, & Lupeol |
| | | | | 1/6 | 1.6-2.0X increase in Amyrin & Cycloartenol |
| | | | | 1/6 | 1.5X increase in Amyrin & Lupeol |
| 531E5 | | | 690 | 3/7[2] | 2X increase in Amyrin, Lupeol, & Cycloartenol |
| | | | | 1/7 | 1.5-2X increase in Phytosterols[5] |
| | | | | 1/7 | Decrease in Amyrin, Lupeol, & Cycloartenol |
| 555D4 | | | 707 | 3/6 | 2-3X increase in Cycloartenol |
| | | | | 4/6 | 1.5-2X increase in Lupeol |
| | | | | 1/6 | 2X increase in Triterpenes[3] & decrease in Phytosterols[5] |
| 535A8 | | 35890 | 699 | 3/5 | 1.6-2.0X increase in Triterpenes[3] |
| | | | | 1/5 | 2X increase in β-Amyrin |
| 533A6 | | 117953 | 738 | 5/10 | 2-4X increase in Triterpenes[3] |
| | | | | 1/10 | 2X increase in Cycloartenol & Lupeol & decrease in Phytosterols[5] |
| | | | | 2/10 | 1.8X increase in Squalene |
| | | | | 2/10 | 1.3-2.5X increase in Phytosterols[5] |
| | | | | 1/10 | 1.6X increase in β-Amyrin & decrease in Phytosterols[5] |
| 554G10 | | | 177 | 3/4 | Increase in Triterpenes[3] |
| | | | | 1/4 | 2X increase in Amyrin |
| | | | | 1/4 | 1.5X increase in Phytosterols[5] |
| 533C5 | | 27175 | 684 | 3/5 | 4-8X increase in Triterpenes[3] |
| | | | | 3/5 | 3X increase in Squalene |
| | | | | 3/5 | Decrease in Phytosterols[5] |
| | | | | 2/5 | 1.6-2X increase in β-Amyrin |
| 535A7 | | 42533 | 710 | 2/7 | 1.5-1.7X increase in Stigmasterol |
| | | | | 3/7 | 1.6-6X increase in Triterpenes[3] |
| | | | | 2/7 | 1.3-1.8X increase in Phytosterols[5] |
| | | | | 2/7 | 1.5X increase in β-Amyrin |
| | | | | 1/7 | 3X increase in Squalene |
| | | | | 1/7 | Decrease in Phytosterols[5] |
| 533B6 | | 143475 | 740 | 2/6 | 1.5-2X increase in Phytosterols[5] |
| | | | | 1/6 | 2X increase in Triterpenes[3] |
| | | | | 1/6 | 1.6X increase in Lupeol |

TABLE 5-continued

Modulation of carotenoid, phytosterol, and/or tocopherol levels in tomatoes transformed with a regulatory protein

| Regulatory Protein Gemini ID | Regulatory Protein cDNA ID | Regulatory Protein Clone ID | Regulatory protein SEQ ID NO: | # of Events Modulated/ # of Events Tested | Fold-Increase or Decrease[1] |
|---|---|---|---|---|---|
| 539D5 | | 207419 | 759 | 2/5 | 6X increase in Triterpenes[3] |
| | | | | 2/5 | Decrease in Phytosterols[5] |
| | | | | 1/5 | 1.5-2X increase in Phytosterols[5] |
| 5110E1 | | | 956 | 3/3 | Increase in ζ-carotene. |

[1]Fold-increase or decrease relative to wild-type tomato fruit at the four weeks post-breaker stage.
[2]Similar results were obtained in fruit from $T_1$ plants.
[3]Triterpenes include α-amyrin, β-amyrin, lupeol, and cycloartenol.
[4]Carotenoids include lycopene, β-carotene, δ-carotene, and ζ-carotene.
[5]Phytosterols include three major sterol forms: campesterol, sitosterol, and stigmasterol.
[6]Carotenes include β- and δ-carotene.
[7]Tocopherols include α-, β-, δ-, and γ-tocopherol.

Example 7

Determination of Functional Homolog and/or Ortholog Sequences

A subject sequence was considered a functional homolog or ortholog of a query sequence if the subject and query sequences encoded proteins having a similar function and/or activity. A process known as Reciprocal BLAST (Rivera et al., *Proc. Natl. Acad. Sci. USA,* 95:6239-6244 (1998)) was used to identify potential functional homolog and/or ortholog sequences from databases consisting of all available public and proprietary peptide sequences, including NR from NCBI and peptide translations from Ceres clones.

Before starting a Reciprocal BLAST process, a specific query polypeptide was searched against all peptides from its source species using BLAST in order to identify polypeptides having sequence identity of 80% or greater to the query polypeptide and an alignment length of 85% or greater along the shorter sequence in the alignment. The query polypeptide and any of the aforementioned identified polypeptides were designated as a cluster.

The main Reciprocal BLAST process consists of two rounds of BLAST searches; forward search and reverse search. In the forward search step, a query polypeptide sequence, "polypeptide A," from source species SA was BLASTed against all protein sequences from a species of interest. Top hits were determined using an E-value cutoff of $10^{-5}$ and an identity cutoff of 35%. Among the top hits, the sequence having the lowest E-value was designated as the best hit, and considered a potential functional homolog or ortholog. Any other top hit that had a sequence identity of 80% or greater to the best hit or to the original query polypeptide was considered a potential functional homolog or ortholog as well. This process was repeated for all species of interest.

In the reverse search round, the top hits identified in the forward search from all species were BLASTed against all protein sequences from the source species SA. A top hit from the forward search that returned a polypeptide from the aforementioned cluster as its best hit was also considered as a potential functional homolog or ortholog.

Functional homologs and/or orthologs were identified by manual inspection of potential functional homolog and/or ortholog sequences. Representative functional homologs and/or orthologs are shown in FIGS. 1-115. The percent identities of functional homologs and/or orthologs are provided in the sequence listing.

Other Embodiments

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (956 sequences)

SEQ ID NO: 1 - DNA, 1588 bp, Arabidopsis thaliana
  misc_feature (1)..(1588): Ceres CDNA ID no. 13653045
  misc_feature (1)..(1588): Also Known As Ceres GEMINI ID no. 5110A5
atgcaagtaagtgtagcaggcattgcttttgattattattgacttgatcatacttgaaattgttggctctttgggtttaggttacaaaagttgctcgaatgttggctgcaaaatcggagattgatgtgaaaggatgtactgtgatggctctcttagatggagggacgctaagaaggcacaaaagctggctaaaggttggattttgatagttcggtttcttattaagttagatagattaggttgtgacttagtcagcaagtttaacttttctttcaggctgagccaccagcaattttggttgctacggtagcaagtttgtgtcacatgctagaaaagcacatatttagaattgactcggtgagagttcttgttgtagatgaggtaaaaactttctcaactatgtattgtacttttcagcttattctccttgggaaatgattgaggctgttctggatattgaacatcattctcggaacattttctcacccaggaatatatttgaatggtcactttgataggttgatttcttattctactcatcaaagcaagttggttctgtgcggaagcttttgacatcattttcttcatgcgataaacgtcagacagtttttgcaagtgcttctattccccagcataaacattttgtgcatgactgtatacaacaaaagtggacaaaggttagcttatgaatgattcttttgctgtcaactatgttcgggatttggtctatataacaaaattacaattctgaaccaaatgattttcaagtcaattgtccctttttatatatttctgcagagggatgttgtccatgttcatgttagcgcaatcatgcccatgccgttgtgccttcttcacagatttgttgtaagacataacttgttccacttatttttccattatatgcatctgttagtacatctaatctctactttggcagatgtgtgagaagacaaacaagcatcaagtactacttgccttgttagagtctgatgcacctgaatcagctatcatttttgtcggcgagcaggtattggaaacctctatttccctttttacttcagttaatctaaccatttaacactattttctgattcttcttttcagtctgagaagtcaaaaaaggctggaaatgatccatctacaactctactaatggaattcctaaaaacttcatataaaggctcgctggagatcctcctactagagggggatatgaatttcaattcacgagcagcttcactaacagtacgtggttttattgtttgcggataattatcctagatgcttactttttgttactaaccttcatgatttgccataggaaatcaggcaaggaggagggtttcttcttgtttctactgatattgcagcaagagggattgatctaccagaaacaactcatatttttaactttgatctcccacaaacggttacagattatctgcaccgagctggaagagctggtcgaaaacccttttctgacaggaagtgcattgtcgctaatctgatcacctcggaggaaagatttgtcttgcaaagatacgaaaatgaacttatgttcagctgcgaggaaatgatgttgtag

SEQ ID NO: 2 - protein, 315 aa, Arabidopsis thaliana
  misc_feature (1)..(315): Ceres CDNA ID no. 13653045
  misc_feature (1)..(315): Also Known As Ceres GEMINI ID no. 5110A5
  misc_feature (1)..(116): Pfam Name: DEAD Pfam Description: DEAD/DEAH box helicase
  misc_feature (203)..(279): Pfam Name: Helicase_C Pfam Description: Helicase conserved C-terminal domain
MQVTKVARMLAAKSEIDVKGCTVMALLDGGTLRRHKSWLKAEPPAILVATVASLCHMLEKHIFRIDSVRVLVVDEVDFLFYSSKQVGSVRKLLTSFSSCDKRQTVFASASIPQHKHFVHDCIQQKWTKRDVVHVHVSAIMPMPLCLLHRFVMCEKTNKHQVLLALLESDAPESAIIFVGEQSEKSKKAGNDPSTTLLMEFLKTSYKGSLEILLLEGDMNFNSRAASLTEIRQGGGFLLVSTDIAARGIDLPETTHIFNFDLPQTVTDYLHRAGRAGRKPFSDRKCIVANLITSEERFVLQRYENELMFSCEEMML

SEQ ID NO: 3 - DNA, 681 bp, Arabidopsis thaliana
  misc_feature (1)..(681): Ceres CDNA ID no. 23381275
  misc_feature (1)..(681): Also Known As Ceres GEMINI ID no. 5109H11
atgatggatagaggagaatgcttgatgtcgatgaagcttagaccgatggtgacgaggccatcttcggatgggactttattttggccgtttagggaagagagagcgtttgcgtcagctgaggagtatggcggcggaggtggttgcatgtggccaccgaggtcttactcatgcagcttttgcgggagagagttcaagtcggcgcaagcactaggcggtcatatgaacgttcatcgaagagaccgagctcgactcaaacaacaatcattatcaccttcatcaactgaccaagccacacctcctgaatgtgatcgtcaacaacaagttcttgatgtgggatcaaaggttcttgttcaagaagaaacaagaaagcctaacggaaccaagagggagataagtgatgtttgtaataacaacgttttagaaagttctatgaaaagatatgaacatgacaatggtgaagtcaagactgacttatcggtcggtctactgagtactgagtttgatcctcggaagaagcaactaatcaacggatcatcttcgtcatggaagagggcaaagacggatgtgtcaagatttccaatgatgttagggttggtcattggaatttccgagatcaacggccatcatgaggagttggatcttgagctaaggctaggagctgatccgcctaaggttaactag

SEQ ID NO: 4 - protein, 153 aa, Arabidopsis thaliana
  misc_feature (1)..(153): Ceres CDNA ID no. 23381275
  misc_feature (1)..(153): Also Known As Ceres GEMINI ID no. 5109H11
MNVHRRDRARLKQQSLSPSSTDQATPPECDRQQQVLDVGSKVLVQEETRKPNGTKREISDVCNNNVLESSMKRYEHDNGEVKTDLSVGLLSTEFDPRKKQLINGSSSSWKRAKTDVSRFPMMLGLVIGISEINGHHEELDLELRLGADPPKVN

SEQ ID NO: 5 - DNA, 1518 bp, Arabidopsis thaliana
  misc_feature (1)..(1518): Ceres CDNA ID no. 23480178
  misc_feature (1)..(1518): Also Known As Ceres GEMINI ID no. 5111C1
atggagagtgatttgattgatttgttcgagggagctaagaaggcagccgatgcggcggctcttgacggtgttacctcttcaggtcctgaggtttctcaatgtatcgatgcccttaaacagctcaagaagtttcctgtcacatacgataccctcgttgcgactcaggttcgtttctgattatcttctcgtaaccctaaaaaagattgatttattttgcatttaggaaaaggtttatatatgttgcatttaggagggtttttctaggtgttgattgcttaatctcgttgcattgacttgtgttgttgttaccttagatttttaattagggttatttaatttcatctgaaaaagtttatagaagtttaaaaagagtaactttaattcaatagatgaagaagcttgagctaactgatttgtataattgactaattgtttgtacgtccccgttgatattgttggaacaaaccaatttggacattatcctctggaatgttgatagtgtgtgtatttgcttttgagaaagttatattcttttcttgcttccaggtgggaaagaagctgaggtctcttgcaaaacatcctgttgaagatatcaaaagcgtagctactgatctgcttgagatatggaagaaagttgtcattgaagagacagccaaagctaagaaaaccgaaggcactaacggttgtaaagaggctaaggtgaataagatggatgttgagaagccttcaaatcctgctcctgttaaagttcagaaacttcagaggggtgattcggctaagagtatcaaggttgagagaaaggaacctgacaataaagttgttaccggtgtcaagatagagagaaaggtacctgacatcaaagtcaccaatggaaccaagatagattatcgtggtcaggctgtgaaagatgaaaaggtctcaaaggacaaccaatcaagtatgaaagctccagctaaagcagctaatgctcctccaaaactaactgcaatgctcaaatgcaatgatcctgtgcgtgacaaaatccgtgagttgcttgtggaggcgttgtgcagggttgctggagaagctgatgactatgagagagagtcagtaaatgctagtgatcctttacgtgttgctgtctcagtggaatcactgatgtttgagaaattgggtcgctcaactggagctcagaagcttaagtacagatctataatgttcaacctgagggatagtaacaacccggacttaagaaggagggttctcactggggagatttcaccagagaaactcataacattgtctgccgaagatatggcaagtgacaagaggaaacaagagaacaaccagatcaaagagaaagccctgtttgattgtgagcgtggtcttgctgcaaaagcatctaccgaccagttcaagtgcgggcggtgtggtcagcgcaaatgcacctactatcagatgcaaacaagaagtgctgatgagccaatgacgacttatgttacatgtgttaactgtgacaaccactggaagttctgttga

SEQ ID NO: 6 - protein, 378 aa, Arabidopsis thaliana
  misc_feature (1)..(378): Ceres CDNA ID no. 23480178
  misc_feature (1)..(378): Also Known As Ceres GEMINI ID no. 5111C1
  misc_feature (206)..(327): Pfam Name: TFIIS_M Pfam Description: Transcription factor S-II (TFIIS), central domain
  misc_feature (338)..(376): Pfam Name: TFIIS_C Pfam Description: Transcription factor S-II (TFIIS)
MESDLIDLFEGAKKAADAAALDGVTSSGPEVSQCIDALKQLKKFPVTYDTLVATQVGKKLRSLAKHPVEDIKSVATDLLEIWKKVVIEETAKAKKTEGTNGCKEAKVNKMDVEKPSNPAPVKVQKLQRGDSAKSIKVERKEPDNKVVTGVKIERKVPDIKVTNGTKIDYRGQAVKDEKVSKDNQSSMKAPAKAANAPPKLTAMLKCNDPVRDKIRELLVEALCRVAGEADDYERESVNASDPLRVAVSVESLMFEKLGRSTGAQKLKYRSIMFNLRDSNNPDLRRRVLTGEISPEKLITLSAEDMASDKRKQENNQIKEKALFDCERGLAAKASTDQFKCGRCGQRKCTYYQMQTRSADEPMTTYVTCVNCDNHWKFC

SEQ ID NO: 7 - protein, 367 aa, Oryza sativa subsp. japonica
  misc_feature (1)..(367): Public GI No. 50919393
  misc_feature (1)..(367): Functional Homolog of  Ceres CDNA ID no. 23480178 at SEQ ID NO. 6 with e-value of 4.20E-101 and percent identity of 61.4
MERELLETFEAAKKAADAAAGADDSPEADRCLDAMRRLRGLRVTTDVLVSTQVGKRLRYLTKHPHSDIQSMATDLLGYWKKVVIEEGKKNGTTENVGSTNSAARAEKAQPMKVDKSSASGSVKPEKREVNVRGQKPESIKVEKITNNDSKNQQVKVERAPKEATRTPDTKKPSSVPNGPPKLTSLVKCNDPTRDKIRELLADAFSRVHGETSKDDREEVRNILDEVDARDPFRVAVTVESALFERLGRSTGAHKAKYRSIMFNLRADNNTDFRRRVLLGQVRPERLVDISPEEMASDARKLENKQIKEKALFDCERGGAPKATTDQFKCGRCGQRKTTYYQLQTRSADEPMTTFVTCVNCNNHWKFC

SEQ ID NO: 8 - protein, 368 aa, Glycine max
  misc_feature (1)..(368): Ceres CLONE ID no. 480672
  misc_feature (1)..(368): Functional Homolog of  Ceres CDNA ID no. 23480178 at SEQ ID NO. 6 with e-value of 5.00E-98 and percent identity of 60.3
MEKELVELYEAAKKAADAAISGDGKHEESRCIDALEQLKKFPVNYKILVNTQVGKHLKVLTKHPRLKIKAFAIDLIEIWKGIIIKETSKNKNGGSDSKVESANGEKSKAGKMQKSPSVKVEKGETVKVEKIDRNGTTKSSSENMKKVQNDVKNEKTDRSASVKVEKIAKEEKPVSGAKKMSSSSAAPPKLKTMIKSNDATRDKIREILHEALSKVTGEADEDLVDVVNNSDPIRVAVTVESVLFEKWGPSNGAQKVKYRSLMFNLKDSNNPDFRRKVLLGVIEPEQLINMSTAEMASEQRKQEYQKITEKALFECERGGPPKATTDQFKCGRCGQRKTTYYQMQTRSADEPMTTYVTCVVCNNRWKFC

SEQ ID NO: 9 - protein, 368 aa, Zea mays
  misc_feature (1)..(368): Ceres CLONE ID no. 245039
  misc_feature (1)..(368): Functional Homolog of  Ceres CDNA ID no. 23480178 at SEQ ID NO. 6 with e-value of 8.29E-96 and percent identity of 57.3
MDRELLETFDAAKKAADAAAGDGNSPEAGRCLDALRRLRDIRVNTDILVSTQVGKRLRPLTKHPHSGIQAVAADLFGYWKKVVLEESGKKNGGSENERSSDSSGKVEKARSVKIEKNSASASMKLEKRDVDVRGQKPNNAKVEKTTSNGSKAQSVKVERVSKEVIRTPDAKRPASVPNGHPKLTSLVKCNDPTRDKIRELLAEAFVRVSRETSDDDRDEVRNILDEVEARDPYRVAVTVESALFERLGPSTGTHRAKYRSIMFNLRAESNTDFRRRVLIGLVAPERLPDVSPDEMASDARKQENMQIKEKALFDCERGAAPKATTDQFKCARCGQRKTTYYQLQTRSADEPMTTFVTCVNCNNHWKFC

SEQ ID NO: 10 - protein, 368 aa, Zea mays
  misc_feature (1)..(368): Ceres CLONE ID no. 229156
  misc_feature (1)..(368): Functional Homolog of  Ceres CDNA ID no. 23480178 at SEQ ID NO. 6 with e-value of 2.20E-95 and percent identity of 56.8
MDRELLETFDAAKKAADEAAGDGNSPEAGRCLDALRRLRDIRVNTDILVSTQVGKRLRPLTKHPHSGIQAVAADLFGYWKKVVLEESGKKNGGSENERSSDSSGKVEKVRPVKIEKNSASASMKLEKRDVDVRGQKPNNVKVEKTTSNGSKAQSVKVERVSKEVIRTPDSKRPASVPNGHPKLTSLVKCNDPTRDKIRELLAEAFVSVSRETSDDDRDEVKNILDEVEACDPYRVAVTVESALFERLGPSTGTHRAKYRSIMFNLRAENNTDFRRRVLIGLVAPERLPDIPPDEMASDARKQENMQIKEKALFDCERGAAPKATTDQFKCARCGQRKTTYYQLQTRSADEPMTTFVTCVNCNNHWKFC

SEQ ID NO: 11 - DNA, 1431 bp, Arabidopsis thaliana
  misc_feature (1)..(1431): Ceres CDNA ID no. 23486285
  misc_feature (1)..(1431): Also Known As Ceres GEMINI ID no. 5110C4
atgaagagacctcgacctacatctcagccgtcgatctcttccaccgtcaaaccaccactgtctccgccggtcacaccgattctcaaacagaagctacacagaacaggaacacctaaatggttcccgttaaaactaacccacacggagctgacgttgccgttaacttttccgacgggtcaaacattccggtggaagaaaactggagcgattcagtatagcggaacgattgggcctcacttagtctctcttagacaacgtccaggagacgacgcagtttcctactgcgtccattgtagcacaagccctaaatccgcggagcttgcgttgctcgattttctcaatgctgagatctcgttagctgagctatggtctgatttctcgaaaaaagatcctcgtttcggagagctagcgagacatctccgtggcgctcgtgtgttgaggcaggatccgctcgagtgcttgatacagtttttgtgctcatcgaacaataacattgcgaggattacgaagatggtggattttgtttcgtctttagggttacatttgggtgacattgatggatttgagtttcatcagttcccatcattggatcgattatctagggtttctgaggaagagtttagaaaggctggttttggttacaggtgatttcatcactctctaatggttgcattatgttgaattagacatttaggctaaaactttgcttgaagcttatacttttatttactctgtggctatacattcatagaattgaagctaatgtttggtctaagctagataatcattgtgtggccgtttctctgattggttctgatctcatttgaaaactctcattctggtttatcttgtggtgagcagagccaaatacataacaggtacagtgaatgctttgcaagcaaagccaggtggtggtaatgaatggcttctttctctgcgcaaagtcgaactccaagaggcagttgctgcgctgtgtacattacctggtgttggtccgaaggtagcagcttgcatagctctgttttctcttgatcagcatagtgctattccggttgacacacatgtctggcaggtaacaaagtccatcggtttctatgtattgtacttacttaattgagatccaattacataatggtgatgatgacttcgggcaactttttttttgttctgttttggataatggatcagatcgcaacaaattatctactgccagaccttgctggtgcaaaactgacacctaaactccatggccgagttgcagaagcctttgtgagtaaatatggtgaatatgctggttgggctcaaacattgcttttcattgccgagttacctgcacaaaaaactctcttgcaatcgttttcccagcccattaacaaactggatgagtctgcagaagttaatgaaactagctgtgatacgttgaagccatga

SEQ ID NO: 12 - protein, 365 aa, Arabidopsis thaliana
  misc_feature (1)..(365): Ceres CDNA ID no. 23486285
  misc_feature (1)..(365): Also Known As Ceres GEMINI ID no. 5110C4
  misc_feature (155)..(310): Pfam Name: HhH-GPD Pfam Description: HhH-GPD superfamily base excision DNA repair protein
  misc_feature (42)..(154): Pfam Name: OGG_N Pfam Description: 8-oxoguanine DNA glycosylase, N-terminal domain
MKRPRPTSQPSISSTVKPPLSPPVTPILKQKLHRTGTPKWFPLKLTHTELTLPLTFPTGQTFRWKKTGAIQYSGTIGPHLVSLRQRPGDDAVSYCVHCSTSPKSAELALLDFLNAEISLAELWSDFSKKDPRFGELARHLRGARVLRQDPLECLIQFLCSSNNNIARITKMVDFVSSLGLHLGDIDGFEFHQFPSLDRLSRVSEEEFRKAGFGYRAKYITGTVNALQAKPGGGNEWLLSLRKVELQEAVAALCTLPGVGPKVAACIALFSLDQHSAIPVDTHVWQIATNYLLPDLAGAKLTPKLHGRVAEAFVSKYGEYAGWAQTLLFIAELPAQKTLLQSFSQPINKLDESAEVNETSCDTLKP

SEQ ID NO: 13 - DNA, 1129 bp, Arabidopsis thaliana
  misc_feature (1)..(1129): Ceres CDNA ID no. 23492765
  misc_feature (1)..(1129): Also Known As Ceres GEMINI ID no. 5110C3
atggcgaattcaatggctacactttctagaagactctatcgatctcttctatcgaaccctagaatttctcaagcttccatgtctttctgtaccaacaacatcacttccccagaagactccgactttgacgagttagaatcgcccattgaaccaaaggcctcagatccagtttctcgattttccggagaagaacgcgttatggaagagcgtccactcgaaaatggccttgactctggcattttcaaggtatcaaacttagattctaattccaattgatacatactctgtttttgttgtttttcttaaatcgatcgttgcaattttgccttttgtatgatctttgttgagtcattttgtgaacatcattagattctcgttctggataggttaataattagtgtgttctagactaatttctggtttaatacaggcaatattggtggggcaagtgggtcagcttcctctgcagaagaagcttaagagtggtagaactgtcactctcttctctgtaggaactggtgggatcaggaacaaccggagaccgcttattaacgaagatccgagagagtatgcgagccggtctgcggtgcagtggcaccgtgtctctgtttaccctgaacgcttggcagatcttgtgttgaagaatgttgaacccgggttagttctcttctgagatcatatttagcttgtaaggttatgtgatgatagaataaggaacaaatgtatgtatcatgtctgatatcgatcaagaatcggtgaaaaaggatgaaactttaggtgaatcttgcttgctagattcaaaatggtagcttgcttttgtgtatgtgtcataacaacttgtttcgtgttcattcaacagtactgttatctacttagagggtaatctggagacgaagatattcactgatcctgtcactggtttggttcgacgtataagagaagtagcaattcgtagaaacggtactaatggctcaacccctaaaactccatttcttacatatttcattgggaaacaattaaatattgatctctgttttctctccttacaggccgagttgtgtttttgggaaaagccggtgatatgcagcaaccgagttctgctgagcttagaggcgttggctactactga

SEQ ID NO: 14 - protein, 217 aa, Arabidopsis thaliana
  misc_feature (1)..(217): Ceres CDNA ID no. 23492765
  misc_feature (1)..(217): Also Known As Ceres GEMINI ID no. 5110C3
  misc_feature (80)..(197): Pfam Name: SSB Pfam Description: Single-strand binding protein family
MANSMATLSRRLYRSLLSNPRISQASMSFCTNNITSPEDSDFDELESPIEPKASDPVSRFSGEERVMEERPLENGLDSGIFKAILVGQVGQLPLQKKLKSGRTVTLFSVGTGGIRNNRRPLINEDPREYASRSAVQWHRVSVYPERLADLVLKNVEPGTVIYLEGNLETKIFTDPVTGLVRRIREVAIRRNGRVVFLGKAGDMQQPSSAELRGVGYY

SEQ ID NO: 15 - protein, 224 aa, Zea mays
  misc_feature (1)..(224): Ceres CLONE ID no. 381106
  misc_feature (1)..(224): Functional Homolog of  Ceres CDNA ID no. 23492765 at SEQ ID NO. 14 with e-value of 1.20E-53 and percent identity of 55.8
MAASSASLLARRLIMSRRFLSSPLGSLSTTTTTRSFSISSPGFKSFVVESDLENEQDQRPADQNRQQTSNSPRPPDTTRPLENGLDPGIYKAILVGKVGQEPMQKRLRSGKTVVLFSLGTGGIRNNRRPLDREEPHQYADRCSVQWHRVCVYPDRLGTVALNNVKTGTILYLEGNLETKVFCDPITGLVRRIREIAVRSSGRLLFLGNDANAPKLGEVKGVGYF

SEQ ID NO: 16 - protein, 224 aa, Oryza sativa subsp. japonica
  misc_feature (1)..(224): Public GI No. 55297106
  misc_feature (1)..(224): Functional Homolog of  Ceres CDNA ID no. 23492765 at SEQ ID NO. 14 with e-value of 1.80E-54 and percent identity of 55.3
MAATASSFLARRLLLTRRVLSSPLRPFSTTDSSSSSSSSSSSDDSRAGSDAGPDPEQQQPPPAGQDQQAAARPRAGDTRPLENGLDPGIYKAIMVGKVGQEPIQKRLRSGRTVVLFSLGTGGIRNNRRPLDREEPHQYAERCSVQWHRVCIYPERLGSLALKHVKTGSVLYLEGNLETKVFSDPITGLVRRIREIAVRSNGRLLFLGNDCNAPKLGEAKGVGYF

SEQ ID NO: 17 - protein, 218 aa, Oryza sativa subsp. japonica
  misc_feature (1)..(218): Public GI No. 34911652
  misc_feature (1)..(218): Functional Homolog of  Ceres CDNA ID no. 23492765 at SEQ ID NO. 14 with e-value of 3.10E-50 and percent identity of 55.0
MAATASSFLARRLLLTRRVLSSPLRPFSTTDSSSSSSSSSSSDDSRAGSDAGPDPEQQQPPPAGQDQQAAARPRAGDTRPLENGLDPGIYKVGQEPIQKRLRSGRTVVLFSLGTGGIRNNRRPLDREEPHQYAERCSVQWHRVCIYPERLGSLALKHVKTGSVLYLEGNLETKVFSDPITGLVRRIREIAVRSNGRLLFLGNDCNAPKLGEAKGVGYF

SEQ ID NO: 18 - DNA, 519 bp, Arabidopsis thaliana
  misc_feature (1)..(519): Ceres CDNA ID no. 23495742
  misc_feature (1)..(519): Also Known As Ceres GEMINI ID no. 5109D9
atgggtcggagaaagatcaagatggagatggttcaggacatgaacacacgacaggttaccttttcaaaacggaggactggtttgttcaagaaggcgagcgagttagccacgctctgcaacgctgagttgggcatcgttgtcttttcaccaggaggcaagcctttctcctacgggaaaccgaatcttgattctgttgcagagcgattcatgagagaatatgatgattcagacagtggcgatgaagaaaaaagtggtaattacaggcctaaactgaagaggctgagtgaacgtctcgatttgctcaaccaagaggttgaagctgagaaggaacgaggcgagaagagtcaggagaagcttgaatctgctggggatgagagattcaaggagtccattgagacgcttaccctcgatgaactcaatgaatacaaagataggcttcagacagtccatggtaggattgaaggtcaagtcaatcacttgcaggcttcgtcttgcctcatgcttctctccagaaaatag

SEQ ID NO: 19 - protein, 172 aa, Arabidopsis thaliana
  misc_feature (1)..(172): Ceres CDNA ID no. 23495742
  misc_feature (1)..(172): Also Known As Ceres GEMINI ID no. 5109D9
  misc_feature (9)..(59): Pfam Name: SRF-TF Pfam Description: SRF-type transcription factor ( DNA-binding and dimerisation domain)
MGRRKIKMEMVQDMNTRQVTFSKRRTGLFKKASELATLCNAELGIVVFSPGGKPFSYGKPNLDSVAERFMREYDDSDSGDEEKSGNYRPKLKRLSERLDLLNQEVEAEKERGEKSQEKLESAGDERFKESIETLTLDELNEYKDRLQTVHGRIEGQVNHLQASSCLMLLSRK

SEQ ID NO: 20 - protein, 186 aa, Glycine max
  misc_feature (1)..(186): Ceres CLONE ID no. 681294
  misc_feature (1)..(186): Functional Homolog of  Ceres CDNA ID no. 23495742 at SEQ ID NO. 19 with e-value of 3.90E-27 and percent identity of 45.3
MGRRKIEIATLKDPNTRQVTFSKRRTGLFKKANELSILCGAEIAIVVFSIGNKPYSFGHPGVDVIAAKFLQEAANSSDAKQIDAQGNNPSNELGDMNRLNQQLSDVQTQILEEEKKGAEHDERLKQHQVTQLSQYKELQASYLELQHRVKDYVNAIEVSECMILLAQEPVVGITKQMTATKRRKKN

SEQ ID NO: 21 - DNA, 503 bp, Arabidopsis thaliana
  misc_feature (1)..(503): Ceres CDNA ID no. 23497949
  misc_feature (1)..(503): Also Known As Ceres GEMINI ID no. 5109C2
atggcaatcttccgaagtacactagttttactgctgatcctcttctgcctcaccacttttgaggttcataacttttgtctttacttctccatgaatcatttgcttcgtcttatccttaattcatatgtgtttgatcaatgataataattcatcattctcttcagcttcatgttcatgctgctgaagattcacaagtcggtgaaggcgtagtgaaaattggtatgtaacgctaacatatatgtaaagtgttatatctctgtttatatatgatttttaaacggttaaaaactagtcatatgtgtataaatatatcatgtgaagattgcggtgggagatgcaaaggtagatgcagcaaatcgtcgaggccaaatctgtgtttgagagcatgcaacagctgttgttaccgctgcaactgtgtgccaccaggcaccgccgggaaccaccacctttgtccttgctacgcctccattaccactcgtggtggccgtctcaagtgcccttaa

SEQ ID NO: 22 - protein, 99 aa, Arabidopsis thaliana
  misc_feature (1)..(99): Ceres CDNA ID no. 23497949
  misc_feature (1)..(99): Also Known As Ceres GEMINI ID no. 5109C2
  misc_feature (3)..(99): Pfam Name: GASA Pfam Description: Gibberellin regulated protein
MAIFRSTLVLLLILFCLTTFELHVHAAEDSQVGEGVVKIDCGGRCKGRCSKSSRPNLCLRACNSCCYRCNCVPPGTAGNHHLCPCYASITTRGGRLKCP

SEQ ID NO: 23 - protein, 99 aa, Arabidopsis thaliana
  misc_feature (1)..(99): Public GI No. 7321080
  misc_feature (1)..(99): Functional Homolog of  Ceres CDNA ID no. 23497949 at SEQ ID NO. 22 with e-value of 9.89E-45 and percent identity of 84.8
MAVFRSTLVLLLIIVCLTTYELHVHAADGAKVGEGVVKIDCGGRCKDRCSKSSRTKLCLRACNSCCSRCNCVPPGTSGNTHLCPCYASITTHGGRLKCP

SEQ ID NO: 24 - protein, 97 aa, Glycine max
  misc_feature (1)..(97): Ceres CLONE ID no. 464913
  misc_feature (1)..(97): Functional Homolog of  Ceres CDNA ID no. 23497949 at SEQ ID NO. 22 with e-value of 2.60E-28 and percent identity of 58.7
MAITRSTVVLAILCFILIRAELGIYGEDLHMDAAKNIDCGGKCNYRCSKTSRHKMCIRACNSCCKTCSCVPPGTSGNRDMCPCYASLTTHGGKLKCP

SEQ ID NO: 25 - protein, 92 aa, Oryza sativa subsp. japonica
  misc_feature (1)..(92): Public GI No. 50931505
  misc_feature (1)..(92): Functional Homolog of  Ceres CDNA ID no. 23497949 at SEQ ID NO. 22 with e-value of 2.89E-22 and percent identity of 51.7
MASMAKSLLCISLVAILLLVETTAPHGQAYAIDCGAKCGYRCSKSGRPKMCLRACGTCCQRCGCVPPGTSGNENVCPCYANMTTHNGRHKCP

SEQ ID NO: 26 - DNA, 684 bp, Arabidopsis thaliana
  misc_feature (1)..(684): Ceres CDNA ID no. 23499985
  misc_feature (1)..(684): Also Known As Ceres GEMINI ID no. 5109F10
atgatgtctactgtaccggcctttacctttactgaaccgggtttggttaaccaattatcggatttccagaccggattcactccttgggaattgaactgctccgatctcttctctacaatccatctcgaaccggtcgtaccgagtccttgttctggtgaatccgatgccggttctgtcaaaattaacaccgattttaacggttttgacgaatcgtgtatcggttccatcaaaactaactccggttctgatgattccaaccttttccacggcgtaccgagtcctcaatccgacgaattggactcaaaaaacacgaaaatccgaagtaacgccacgaatcataaccggaacaaattgaaccggtcggttttgcaggtgactgacgaccgtaaacgcaaacggatggaatcaaaccgagaatcagcgaagcggtcgaggatgcgtaaacaaagacacattgataatttaaaagacgaagcaaatcgtctcggtttagaaaaccgggaactcgcaaaccggcttcgaattgttttgtacaacatcgcattaatgtgtacggacaacaatcagcttttgtcggaacaagagattctcagacggagattcttggagatgaggcagattttgattttcagacagcttcagctgaatccatcattgatcatcaatcatcatcatatgatttga

SEQ ID NO: 27 - protein, 227 aa, Arabidopsis thaliana
  misc_feature (1)..(227): Ceres CDNA ID no. 23499985
  misc_feature (1)..(227): Also Known As Ceres GEMINI ID no. 5109F10
  misc_feature (125)..(173): Pfam Name: bZIP_1 Pfam Description: bZIP transcription factor
MMSTVPAFTFTEPGLVNQLSDFQTGFTPWELNCSDLFSTIHLEPVVPSPCSGESDAGSVKINTDFNGFDESCIGSIKTNSGSDDSNLFHGVPSPQSDELDSKNTKIRSNATNHNRNKLNRSVLQVTDDRKRKRMESNRESAKRSRMRKQRHIDNLKDEANRLGLENRELANRLRIVLYNIALMCTDNNQLLSEQEILRRRFLEMRQILIFRQLQLNPSLIINHHHMI

SEQ ID NO: 28 - DNA, 340 bp, Arabidopsis thaliana
  misc_feature (1)..(340): Ceres CDNA ID no. 23500965
  misc_feature (1)..(340): Also Known As Ceres GEMINI ID no. 5109A2
atggcttttgatggttgttgtcctgattgcaaacttcctggagatgattgccctctaagtaaagttctcttctttcatgtcttcgcttttatatatgttgcttagaacacccactatttctcttgcttacggaaacattgctaaacatttacttatggtaataactcaaaacaaaactgcatgccttagaccttatctgttttggtgttttggtgtttgggcagtttggggagcctgcaaccacgcgtttcatcttcactgtatattgaaatgggtgaattcgcagacgagccaagctcattgcccaatgtgcagaagagaatggcagttcaaagagtaa

SEQ ID NO: 29 - protein, 57 aa, Arabidopsis thaliana
  misc_feature (1)..(57): Ceres CDNA ID no. 23500965
  misc_feature (1)..(57): Also Known As Ceres GEMINI ID no. 5109A2
  misc_feature (7)..(49): Pfam Name: zf-C3HC4 Pfam Description: Zinc finger, C3HC4 type (RING finger)
MAFDGCCPDCKLPGDDCPLIWGACNHAFHLHCILKWVNSQTSQAHCPMCRREWQFKE

SEQ ID NO: 30 - protein, 84 aa, Glycine max
  misc_feature (1)..(84): Ceres CLONE ID no. 720493
  misc_feature (1)..(84): Functional Homolog of  Ceres CDNA ID no. 23500965 at SEQ ID NO. 29 with e-value of 5.29E-30 and percent identity of 96.4
MKVKILQWHAIASWTWDAQDETCGICRMAFDGCCPDCKLPGDDCPLIWGVCNHAFHLHCILKWVHSQTSQAHCPMCRREWQFKG

SEQ ID NO: 31 - protein, 84 aa, Oryza sativa subsp. japonica
  misc_feature (1)..(84): Public GI No. 34902720
  misc_feature (1)..(84): Functional Homolog of  Ceres CDNA ID no. 23500965 at SEQ ID NO. 29 with e-value of 6.99E-28 and percent identity of 91.0
MKVKILQWHGVASWTWNAQDETCGICRMAFDGCCPDCKFPGDDCPLIWGSCNHAFHLHCILKWVNSQTSTPLCPMCRREWQFKG

SEQ ID NO: 32 - protein, 84 aa, Triticum aestivum
  misc_feature (1)..(84): Ceres CLONE ID no. 633999
  misc_feature (1)..(84): Functional Homolog of  Ceres CDNA ID no. 23500965 at SEQ ID NO. 29 with e-value of 8.99E-28 and percent identity of 91.0
MKVKILQWHAVASWTWDAQDETCGICRMAFDGCCPDCKFPGDDCPIIWGACNHAFHLHCILKWVNSQTSIPLCPMCRREWQFKG

SEQ ID NO: 33 - protein, 75 aa, Triticum aestivum
  misc_feature (1)..(75): Ceres CLONE ID no. 890999
  misc_feature (1)..(75): Functional Homolog of  Ceres CDNA ID no. 23500965 at SEQ ID NO. 29 with e-value of 1.09E-22 and percent identity of 89.5
MKVKILQWHAVASWTWDAQDETCGICRMAFDGCCPDCKFPGDECPIIWGACNHAFHLHCILKWVNSQTSTALCPM

SEQ ID NO: 34 - protein, 84 aa, Zea mays
  misc_feature (1)..(84): Ceres CLONE ID no. 287128
  misc_feature (1)..(84): Functional Homolog of  Ceres CDNA ID no. 23500965 at SEQ ID NO. 29 with e-value of 1.90E-27 and percent identity of 89.2
MKVKILQWHAVASWTWDAQDETCGICRMAFDGCCPDCKFPGDDCPLIWGVCNHAYHLHCILKWVNSQTSTPLCPMCRREWQFKG

SEQ ID NO: 35 - DNA, 1486 bp, Arabidopsis thaliana
  misc_feature (1)..(1486): Ceres CDNA ID no. 23500996
  misc_feature (1)..(1486): Also Known As Ceres GEMINI ID no. 5110C11
atgtctcacatcgctgttgaaaggaatcgaagaaggcaaatgaacgagcatcttaaatcccttcgttctttgactccttgtttctacatcaaaagggtaaatttcatatttatctgttcgatcccttcatagtcaattagctagtttggatgatatagaaaaaagaactcaattcacaatcctaattattttctcgaagagattggtatttttttaatgatcgttgctttcttttgttgaagttatttcgtagaggttgattcaagatttattccaatttatttatacagacaattgaaccttctcaaattgcttatttaataggatcccagataaaattgtgcaggaaccaaaaatctcttagatacttataattggatcatgcatgataatctttctaatattggatttcccaacttactatttttggaagaaaacaaaatgttgtggcatacatatatagttaatcctatattctcactgtcagacttccttgtttgtatatgttatgcatagactgtatatttctctttggtaactttctttaaacaaactactcggatgcaccaatctgtttaataatcatgtggtcttgttttctatgattgatcggtattagggagatcaagcttcgatcatcggaggagtgatagagttcatcaaagagttgcagcaattggttcaagttcttgagtccaagaaacgtcgaaagaccctaaaccgaccatctttcccttatgatcaccagacaatcgagccatccagtttaggagccgccactacccgagtaccgtttagtcgaatcgaaaatgtgatgaccacaagtactttcaaggaagtaggagcatgctgtaactcccctcatgctaacgtagaagcaaagatttcaggttctaatgttgtattgagagttgtctctaggcgaatcgtggggcagctcgtaaagatcatctctgtcttagagaagctatcttttcaagttcttcacctcaatattagtagcatggaggagactgtcttatactttttcgttgttaaggtacatatcttcatctacatacaaattaaatacattgttagtcaatatattgaacaaccgataaaactcattatatctatcatgaaattagatggaatttggtgttatagaactattacaaagtaaaatgctcctaatgaatgatcaaacaccaattattgctaaaccgatgtcttgcatcgatttagttacttaaccaaattatgactatttaacttgatttgtacttctttaatttacaccaaaagatatatcaatattattagttaagctcaatgtatatatatatggatcagataatatttgtatgagtcttttgttttgaattcgacggaattaaatttacatgtgcagataggattggagtgtcacttaagcttggaggagctaactcttgaagttcagaaaagctttgtgtctgatgaagtgatcgtctctaccaattaa

SEQ ID NO: 36 - protein, 202 aa, Arabidopsis thaliana
  misc_feature (1)..(202): Ceres CDNA ID no. 23500996
  misc_feature (1)..(202): Also Known As Ceres GEMINI ID no. 5110C11
  misc_feature (1)..(50): Pfam Name: HLH Pfam Description: Helix-loop-helix DNA-binding domain
MSHIAVERNRRRQMNEHLKSLRSLTPCFYIKRGDQASIIGGVIEFIKELQQLVQVLESKKRRKTLNRPSFPYDHQTIEPSSLGAATTRVPFSRIENVMTTSTFKEVGACCNSPHANVEAKISGSNVVLRVVSRRIVGQLVKIISVLEKLSFQVLHLNISSMEETVLYFFVVKIGLECHLSLEELTLEVQKSFVSDEVIVSTN

SEQ ID NO: 37 - protein, 191 aa, Glycine max
  misc_feature (1)..(191): Ceres CLONE ID no. 545208
  misc_feature (1)..(191): Functional Homolog of  Ceres CDNA ID no. 23500996 at SEQ ID NO. 36 with e-value of 9.99E-59 and percent identity of 70.5
MSHIAVERNRRRQMNEHLKVLRSLTPCFYIKRGDQASIIGGVIEFIKELHQVLQALESQKRRKSLSPSPGPSPRTLQPMFHQLDSPSMIGTNSFKELGASCNSPVADVEVKISGSYVILKVICHRIPGQVAKIITVLESLSFEVLHLNISSMEETVLYQFVVKIELGCQLSLEELAMEVQQSFCLDAIIAL

SEQ ID NO: 38 - DNA, 3440 bp, Arabidopsis thaliana
  misc_feature (1)..(3440): Ceres CDNA ID no. 23503138
  misc_feature (1)..(3440): Also Known As Ceres GEMINI ID no. 5110A8
atgatgtcatttttcctgcagaaatctaaactattgagttttgtggatagaggccctccatcttgggatcaatgtccacaatccgaaaagaagatatctgtggatggagctcctgatcttttgagaatgaatgcttcttcagatagtttaagaataagttctcctctcatgctgcaattgtcagatgatactatctctgagtctgctaatatgattgaatctataaaagcccggcttatagggaatggtcagacagagaagaggtctagcgatgggaggggaaaagatgaatctaacatggaatcattggagatagccatgtatcaaactgttcgcaacaaaattgaaaacatgataaatcaaagccttacacgtgtagatcatcaaccccatgaagctgaaaattgttcggagaaaaattctgttggtggtccatctactttgcaaggtagatttcctgatattcgatcaagacaaacttccaggcgtcctgatgctggttcagatgggtttcaccctatcgactgtgatggggtttatctttcatcatgtggacatgctgtacatcaaagctgccttgaacgatatttaaaatccttaaaggaaaggtgagccatgtttgacttcctttggtttcgtatgtgaaacaaaaatcttaattactcagcgtgtagataggtgaatatatttttcttttaagttgatacttccttcctacctgttgggcataggttaatcaggcgtgttgaattgattttccttccttgatttacagctgtgatattcacgtttaaaagctttttttggtttgttgggatggtgtaggtctggcagaagaactgtctttgaaggtgcacatattgtggatctaaaaaaggtatttgtgtgaccaatttagagatatttttctggtgctttaacgtactccttctgaagcttaaacattgtttcttctgtcagaaagaattcctgtgtcctgtatgccgccgactagccaattctgtattgcctgaatgtcctggagatttatgttctgtctcaaagctacaagatagtccacgtactaagttacgtagaaaagatgcactgcagccttctctttggctctctgaagcgttgtgtctactacgatctgctgctgaagtgatcgaagatggtgatagaggtaaaacagttactccacagggagatggaccaagaaggaaagatcttaaatctgtctctaaaatgctctgggatttctattttcccaagccagaggataaaactctaaaacgtctgtggctaccaccacaatcaatcgtcatgtgggacacccttaagtactctctcatttcaatggaaattggtactcgttttgccaagaattcaatgctgcctgtctattgtattgactccttgtatgaagagttgaaaacctctaaggggactattttgtcagttttattacgagtggtacagagctccagaacaaagaatactattcatgttcgtcagagatttgtgggtatgaagcatcttgcagagtctatatgctatggagtttcaagtagttcttcgagcagcatatttggaagtgaaggtactttttctccaacactcaagaggaaataaaggacatggaaatgtctgtctacatggcctccgtaattgcaaatattaatgaaatagttgctgactgtagttgtttctcgataacatctgagaatatttgccatcttttcaggcacaacaggttcattgaagaatatagacctgctctggaatcgagcatccgatccagttcttgcccatgacccattttcatcactgatgtgggctctcttttgtcttccttttccttttctcacgtgcgaggaatctctattgtcacttgtgcatattttccacagtgtctcgcttgttcaggtatgccacattgttctctaagtatatacaaatttacctctttagacgtacgtctcctaatctcattgtctttggtgcagactgtaattgcttattgtgcatgtcgcccaagtgaattgagtgaattaaattttggggaaaacctgcttaatgacatctccaacgctttgagagaatcaggtggttgggagtatttcaggtcgaacaatatggatttgtcatgtgatataaaagacacaatccgtaaatatagtcttcctttcttgaggagatgtgcgttgttgtggaagctactgaaatctactcctaggaagcttcatgaagagtcagatatgtttgatttgccatctgaccccaccaccgacaatatggatttcatatacagtccccagtctgagctgaatcatgtgcaagaattggagaaaatgtttaacattccacctatagatatcattcttaatgatgaacttctccgttcttcaacccaaatatggctccagcattttcagcgggaatatagagtcaacagagttaaaaggtccctttgcatcacccctgtagttcctttccagctaatgaaattacccaatctataccaggacctactacaaaggtttgcagcaacgtctctctctggtttttgcacaagttgtttcccattcgaagactttttctctaatcaaaaagccttgttttcttttcttttataggtgtataaaaaaacgttgcgtcaactgcaccaaagttatcgaagaacctgtattatgtcttctgtgtggaagtttgtgttctcccatatggagcccttgttgcaggtattgcctttacttccactagtctccaaacatcgttttggttgacactgttattgttctagaaaaccaaacaatgacgttctaacatacttttacagagaaagtggttgtcctaatcatgcaattacctgtggtgctggtactggtgtatttcttctgatacgggtatcacctctcgtcttctctctctctctctctctcttgtggatataactctcctttactttatatattgctcgtgtatgtatggagtttgcatcatttgtgggctttctaattgattactgctctacatttttcgatagcggaccacaattttgctacaaaggtttgcaagacaatcaccttggccatctccttacctggatacgtttggagaagaggtaaacctagaaagatttttttctttcttttccttttaactttgatgggtacgatcttgttgattcggatgtttccatgctgttggtcattgaatattgtttcaggatatcgatatgatcagaggaaaacgactatacctgaatgaagaacgttatgctgctttaacttacttggtaaatgtttgtctcaacaatcaaaagaagaaacttttgtttgtatggtaaaatatataattgttttgcttggtgaaatccttttcaggttggttctcatggacttgatcgcagttcaaaagttctcggccaaaccacaattggagccgtcttacattaa

SEQ ID NO: 39 - protein, 2006 aa, Arabidopsis thaliana
  misc_feature (1)..(2006): Ceres CDNA ID no. 23503138
  misc_feature (1)..(2006): Also Known As Ceres GEMINI ID no. 5110A8
  misc_feature (119)..(188): Pfam Name: zf-UBR1 Pfam Description: Putative zinc finger in N-recognin
  misc_feature (1394)..(1442): Pfam Name: PHD Pfam Description: PHD-finger
METNSSLFGLVSPSSHDLVIERLASVGVPKKYRSKRGLVEFVRANPAKISELVSALLPTDDDVKLGLKEARERPRKSAVSPTMKKRFRESMNMLQWLMFQDEPDVSLRNLAKLNLDQRGVCGSVWGQNDIAYRCRTCENDPTCAICVPCFQNGDHNSHDYSIIYTGGGCCDCGDETAWKPDGFCSNHKGSEQIRPLSENLANSVGPILDALFTCWNNKLLSAESSGQKGARSNDTLVILQKMSNELTFIVVEMLLEFSMSSESLLSFVSRRIISSSGLLSILLKAERFLDQDVMKKLHDLFLKLIGDPVFKCEFAKAFVSYYPVVISEVVKQGTDNAFKKYPLLSTFSVQILTVPTLTPFLVKEMNLLAMLLGCLSDIFVSCSGEDGLLQATKLERLCETSERVIGDLKFVMSHAIVSKYATHEHRELSRSWLTLLTFAQGMNPLKRETGIPIDEENDYMHLFFVLGHSIAVIHSLLVNGTYSAASDEEIENDRNAKEEFDKCDGDGERYAKVGRLSHEDSVCTAIVSSSSFDSSMASEVHKIDPFHALLPSSAIYLIRECLKVLETCLGNDEGISKFLCKLSSSSGRNIPESKMSWPRRDLLNVETGGSVSSNLASSSRDPSTGLSPLCGDIQTNLSLDNVCGPYGVVQTDVTADSKRVSCNSADLTKNASGLRILGLCDWPDIHYDVSSQAISVHLPLHRLLSLLIQKALRICYGESASYNGVSISHEIPHADFFSSVIGDFHPCGFSALVMEHVLQIRVFCAQVIAGMWKKNGDSALVSCEWYRSVRWSEQGLELDLFLLQCCAALAPADSYVDKLLSRFGLSSYLSLNPDITNEYEPVLVQEMLGLLIQILQERRFCGLSTAESLRREIIFKLATGDFTHSQLVKSLPRDLSKSDELQEVLDDVSVYCNPSGMNQGKYSLQSSCWKELDLYHPRWQSRDLQSAEERFSRYCGVSALTTQLPRWRMIYPPLKGLARIGTCKATFQIISSALYYALQSGTSVKSRAPDGVLITALQLLSLSLDICTQQRQSNSQDCCLENSIPILELAGLEIIGIAQGTEKESLLSLLVSLMKTRMGDGRHQFPEPGSCNISSWIGNLLKKFSAIDSVCMNLLQSLAPEVVGQSGFDKVMSGSTSDEKRKAKAKERQAAIMAKMKAEQSKFLSTLSSSMDDDDPRSEFETSDSVMEHDSEIAVREVCSLCHDPDSKDPVSFLIFLQKSKLLSFVDRGPPSWDQCPQSEKKISVDGAPDLLRMNASSDSLRISSPLMLQLSDDTISESANMIESIKARLIGNGQTEKRSSDGRGKDESNMESLEIAMYQTVRNKIENMINQSLTRVDHQPHEAENCSEKNSVGGPSTLQGRFPDIRSRQTSRRPDAGSDGFHPIDCDGVYLSSCGHAVHQSCLERYLKSLKERSGRRTVFEGAHIVDLKKKEFLCPVCRRLANSVLPECPGDLCSVSKLQDSPRTKLRRKDALQPSLWLSEALCLLRSAAEVIEDGDRGKTVTPQGDGPRRKDLKSVSKMLWDFYFPKPEDKTLKRLWLPPQSIVMWDTLKYSLISMEIGTRFAKNSMLPVYCIDSLYEELKTSKGTILSVLLRVVQSSRTKNTIHVRQRFVGMKHLAESICYGVSSSSSSSIFGSEGTTGSLKNIDLLWNRASDPVLAHDPFSSLMWALFCLPFPFLTCEESLLSLVHIFHSVSLVQTVIAYCACRPSELSELNFGENLLNDISNALRESGGWEYFRSNNMDLSCDIKDTIRKYSLPFLRRCALLWKLLKSTPRKLHEESDMFDLPSDPTTDNMDFIYSPQSELNHVQELEKMFNIPPIDIILNDELLRSSTQIWLQHFQREYRVNRVKRSLCITPVVPFQLMKLPNLYQDLLQRCIKKRCVNCTKVIEEPVLCLLCGSLCSPIWSPCCRESGCPNHAITCGAGTGVFLLIRRTTILLQRFARQSPWPSPYLDTFGEEDIDMIRGKRLYLNEERYAALTYLVGSHGLDRSSKVLGQTTIGAVLH

SEQ ID NO: 40 - DNA, 593 bp, Arabidopsis thaliana
  misc_feature (1)..(593): Ceres CDNA ID no. 23503813
  misc_feature (1)..(593): Also Known As Ceres GEMINI ID no. 5109C9
atgaaatctcttctcggtaatctcaggctttacaagtttgatgtgccttgtgagtctgatgtcggtgttgtattagtaagttatggaggtactaatggttggcacacatgtgaacggtttcgattgacgcgatacacaggacaaggacgaggaagaggttcaaaagctggattgtccaaagcattcgtagatttggtcggttggtctttcatgatgcaacgcgagtccaacataagtaatcagatcttcgactatattgtctccaatttttcattcaaggatcttgatatcgtacctcccgcgtgtcctgtcctcgtctttcactttcaaattagagggtttggtcaagatcgtacagacctgtaccaattgctccaccaacgacggagatcgtagattgttaccaaagttcggaatcttgttgtctctgtcaaaaagggtatccgaaagaagacgagattgttcataaaacaaaatgcaatcatattttttacggaacttgtatctctcgttacttgttgcacactcctcgatgccctgtttgctccgttgagttgccacctgtcgacatccgaacttttctcttcatctaa

SEQ ID NO: 41 - protein, 185 aa, Arabidopsis thaliana
  misc_feature (1)..(185): Ceres CDNA ID no. 23503813
  misc_feature (1)..(185): Also Known As Ceres GEMINI ID no. 5109C9
MKSLLGNLRLYKFDVPCESDVGVVLVSYGGTNGWHTCERFRLTRYTGQGRGRGSKAGLSKAFVDLVGWSFMMQRESNISNQIFDYIVSNFSFKDLDIVPPAVWSRSYRPVPIAPPTTEIVDCYQSSESCCLCQKGYPKEDEIVHKTKCNHIFYGTCISRYLLHTPRCPVCSVELPPVDIRTFLFI

SEQ ID NO: 42 - DNA, 1041 bp, Arabidopsis thaliana
  misc_feature (1)..(1041): Ceres CDNA ID no. 23509939
  misc_feature (1)..(1041): Also Known As Ceres GEMINI ID no. 5110E3
atggagaagttagtacataaagaaattgagaaacgaaggagacaagaaatggcttctctctacgcgtctctccgctctcttctccctttagagttcatccaggtcaaaaccctaattactcttgcttttaatttcttcctcttcttcttcttttttttttgttaaggaaaaagtccacaagtatgctttgtcgcttagtttgttaaaaagattcactagaactctaacactctatcatcacaatatctcaagttgacctctacaccttaattacgtttgatttggttttgtagggaaaacgttcaacgtcagatcaggtgaaaggggcagtgaattacatagactatttgcaaaggaatatcaaagacataaattccaagagagatgacctcgtgttattgtctggacgaagctttaggagtagtaatgaacaagaatggaatgagatttcgaatcatgtcgtgattcgtccgtgtttggtcggcatagagatagtgttgagcattctccaaacgccattctcaagcgttctgcaagtgcttcgtgaacacggtctctatgttcttggctacatctgttccagtgtaaatgatagactcattcatactctacaggctgaggtacaatatctcgagcttactaactttacagcaatcgaagcattactaactttactaagaatatagagaaatacttaatcataacatatatttctaactaactttactaagaatatagagaaatacttaatcataacatatatttctaactttgttaatgttttcgatcttgtcggcttacaaacgcgtttatgtcctaatttggaatggaatatagaatatagcatacatcttcttcatagctttttggaatggcttattgtatcagagtaatgaatatatatgtttgagttaatatgtgaagttgatttgccttatgttgagttaatatgtgaagttgatttgccttatgttgcaggtcaacgatctggctttgatcgacttagcagaccttaaggatacacttaccctgatgaagtaa

SEQ ID NO: 43 - protein, 163 aa, Arabidopsis thaliana
  misc_feature (1)..(163): Ceres CDNA ID no. 23509939
  misc_feature (1)..(163): Also Known As Ceres GEMINI ID no. 5110E3
  misc_feature (2)..(54): Pfam Name: HLH Pfam Description: Helix-loop-helix DNA-binding domain
MEKLVHKEIEKRRRQEMASLYASLRSLLPLEFIQGKRSTSDQVKGAVNYIDYLQRNIKDINSKRDDLVLLSGRSFRSSNEQEWNEISNHVVIRPCLVGIEIVLSILQTPFSSVLQVLREHGLYVLGYICSSVNDRLIHTLQAEVNDLALIDLADLKDTLTLMK

SEQ ID NO: 44 - DNA, 1328 bp, Arabidopsis thaliana
  misc_feature (1)..(1328): Ceres CDNA ID no. 23512013
  misc_feature (1)..(1328): Also Known As Ceres GEMINI ID no. 5111A1
atggcgtaatatgaaagcttcagtgaacttgtgcaaaacgtaatctctgttttctccaattcattctcctctgttagtgctgatgatgtgatccctagagatgctcaaaaagagccgaaattaacggtctcttaccttgttgattcagtgggtataccgataaaattcgcagaatcaatcttgaaggaagtcagctcaaaggacaagtgcaatcccaattctgttctgaatcttctaagaagttatgatttcacagattctcagatatcaagcatcattacgactgatccagaattacttatggaagatgctgagaattccctttgtcccaagcttaagtttttggagtccagagaaattttaagctctaggctcaatgacattgttactagagttccgaaaatcttgaggatggaagaggaaaaatctatgatcacatactatgactttgtcaaaaccattacactaacgagttcgcgttcggacttctataaggtttgcgaactttatccatatattgaaagttctattaggaaggttattgagatgggttttgatcctttcgccccaaaaattttcgatgctacggtcgttgtttgcacattaagcaacgaaacattagaagaaagagtcaatatctataaaacgttaggctttgatgtcagagatgtatgggaaatgttcaagaagtgtcctacttttctgaatatctcggagaagaagataactcagagtttcgaaacattgaagaagtgtggacttgtcgaagaagaagtcatctctatgttccagaagtctccacaatgtattgatttttcagagctggatataactcagaattttgaattcttgaagggatgtggattagtcgaagaagaggtcctctctatgttcaagaggtatccgcaatgtattggtttttcagagaaaaaaatattgaacgcggttgaaacatttttaggccaagggttcagcaaagatgaggtcatgatgatggtcaagtgctatcctccatgtcttaatttatcagcagagtcaattaagaggaagactgattttcttgtcaagaaaatgaattggccacgagaagtcgagaaggcgtggtttcgatccctgtggtacttgaattcagcatggagaaaatgattgtaccgaggtgcaatgttatcaaagctcttacgtccaaaagattgctcaaaactgaagtctcttcaatgttttctgtcttgatatgtcccgatgaggtgtttcttgaaaggtatgtgagtaagcatgatgatcaagaacttgtcgatgagttgatgtctatcttcaccaaagatcagtaa

SEQ ID NO: 45 - protein, 388 aa, Arabidopsis thaliana
  misc_feature (1)..(388): Ceres CDNA ID no. 23512013
  misc_feature (1)..(388): Also Known As Ceres GEMINI ID no. 5111A1
  misc_feature (149)..(284): Pfam Name: mTERF Pfam Description: mTERF
MAADDVIPRDAQKEPKLTVSYLVDSVGIPIKFAESILKEVSSKDKCNPNSVLNLLRSYDFTDSQISSIITTDPELLMEDAENSLCPKLKFLESREILSSRLNDIVTRVPKILRMEEEKSMITYYDFVKTITLTSSRSDFYKVCELYPYIESSIRKVIEMGFDPFAPKIFDATVVVCTLSNETLEERVNIYKTLGFDVRDVWEMFKKCPTFLNISEKKITQSFETLKKCGLVEEEVISMFQKSPQCIDFSELDITQNFEFLKGCGLVEEEVLSMFKRYPQCIGFSEKKILNAVETFLGQGFSKDEVMMMVNREGVVSIPVVLEFSMEKMIVPRCNVIKALTSKRLLKTEVSSMFSVLICPDEVFLERYVSKHDDQELVDELMSIFTKDQ

SEQ ID NO: 46 - DNA, 855 bp, Arabidopsis thaliana
  misc_feature (1)..(855): Ceres CDNA ID no. 23515088
  misc_feature (1)..(855): Also Known As Ceres GEMINI ID no. 5110A1
atgggtcaagatgaggttgggagtgatcagacgcaaatcataaaagggaaacgtacgaagcgacaaagatcgtcttcgacgtttgtggtgacggcggcgacaacagtgacttcaacaagttcatcggccggtggaagtggaggagaaagagctgtttcagatgaatacaactcggcggtttcgtctccggtgactactgattgtacgcaagaagaagaagacatggcgatttgtctcatcatgttagctcgtgggacagttcttccatcgccggatctcaagaactcgagaaaaattcatcagaagatttcgtcggagaattctagtttctatgtgtacgagtgtaaaacgtgtaaccggacgttttcgtcgttccaagcacttggtggacacagagcgagccacaagaagccgaggacgtcgactgaggaaaagactagactacccctgacgcaacccaagtctagtgcatcagaagaagggcaaaacagtcatttcaaagtttccggctcagccctagcttcacaggcaagtaacatcatcaacaaggcaaacaaagtacacgagtgttccatctgcggttctgagttcacttccgggcaagctctcggtggtcacatgaggcggcacaggacagccgtaaccacgattagccccgttgcagccaccgcagaagtaagcagaaacagtacagaggaagagattgagatcaatataggccgttcgatggaacagcagaggaaatatctaccgttggatcttaatctaccagcaccagaagatgatctaagagagtcaaagtttcaagggatagtattctcagcaacaccagcgttaatagattgtcattactag

SEQ ID NO: 47 - protein, 284 aa, Arabidopsis thaliana
  misc_feature (1)..(284): Ceres CDNA ID no. 23515088
  misc_feature (1)..(284): Also Known As Ceres GEMINI ID no. 5110A1
  misc_feature (113)..(135): Pfam Name: zf-C2H2 Pfam Description: Zinc finger, C2H2 type
  misc_feature (188)..(210): Pfam Name: zf-C2H2 Pfam Description: Zinc finger, C2H2 type
MGQDEVGSDQTQIIKGKRTKRQRSSSTFVVTAATTVTSTSSSAGGSGGERAVSDEYNSAVSSPVTTDCTQEEEDMAICLIMLARGTVLPSPDLKNSRKIHQKISSENSSFYVYECKTCNRTFSSFQALGGHRASHKKPRTSTEEKTRLPLTQPKSSASEEGQNSHFKVSGSALASQASNIINKANKVHECSICGSEFTSGQALGGHMRRHRTAVTTISPVAATAEVSRNSTEEEIEINIGRSMEQQRKYLPLDLNLPAPEDDLRESKFQGIVFSATPALIDCHY

SEQ ID NO: 48 - protein, 273 aa, Pisum sativum
  misc_feature (1)..(273): Public GI No. 861091
  misc_feature (1)..(273): Functional Homolog of  Ceres CDNA ID no. 23515088 at SEQ ID NO. 47 with e-value of 2.19E-40 and percent identity of 53.6
MDMEGSIGTKEHLAKGKRTKRGIRMLSPCTVANTTVTSSCSSAIGDGGRSFSSTTFDSTEQEEEADMANCLILLAQGRTGGQEETRCHNHRQQDGGYNNIVTEKATRNGFESYECKTCNRFFHSFQALGGHRASHKKPKMKEIISAGETEEQNNHIHNKNVSTISPLVPPHVSLELRCGGNLNFHGHGNNNKPNRSNKVHECSICGAEFTSGQALGGHMRRHRACTNKNNNNNVGDVHGKTRNILELDLNLPAPEEDLRDSTFQFPAMVGCHY

SEQ ID NO: 49 - protein, 282 aa, Petunia x hybrida
  misc_feature (1)..(282): Public GI No. 2346972
  misc_feature (1)..(282): Functional Homolog of  Ceres CDNA ID no. 23515088 at SEQ ID NO. 47 with e-value of 5.30E-46 and percent identity of 53.3
MEVQMQEDHDHHMNMVIKRRRTKRPRPSSPLALTIATSSCSTVEGTHAGELDGHVANSSSSPSNSGIDILIRNREEEDMANCLILLAQGHNNQKPSPSHSPLDVYQCKTCNRCFPSFQALGGHRASHKKPKLPTNLEEKNSKPIEHVENCSKSNEDHVTTLSLQISNNNINNNNSNNNNNNNIIKNKNRVHECSICGAEFTSGQALGGHMRRHRPLPNSIAIASTSHELESSHEIKNTRNFLSLDLNLPAPEDDHRPETKFSFASKEQVIVFSASPLVDCHY

SEQ ID NO: 50 - DNA, 780 bp, Arabidopsis thaliana
  misc_feature (1)..(780): Ceres CDNA ID no. 23521525
  misc_feature (1)..(780): Also Known As Ceres GEMINI ID no. 5109G12
atggagaccaagcacctacgcaagcttctccagctctaccaagcttgtggtggcgaacaagagctcacaaaaaccgtccaaaacgtcacatcatcaccattgactccaacgccaccaccacagccaccttcggcattagactccactatggctctcaccatctttatcctcttggttgctctcttcttcatgggtttcttttcagtttacttccgccacttcgcagacagttcaagttcaacggttgatatttcttccatgccaagaacaagatcctctaggatgtctccacgtcgcctttccacatccgtcgtcgtatcacggccgtatagtttccggaggggtcttgattctcaggtaaatccatttctctaattatctttctcggttcttatgttaaccggcaagattgggacatttcaggccgttcgatctctgccagtgtaccgttacacgaaagcagcgaagcagcggaacgaagattgcgttatctgcttgagcgatttcgaagaaggtgaaacagttaaagtgataccacattgtggtcacgtgttccacgtagattgcgttgacacgtggctgagctcatacgtaacatgtcccttgtgccggagtaaccagctgttctcggataaggacttgggcatgcaagaaccgcctgatcaggactcggcagaagaacatgacacgtgtgatggtgtggacacttgtgtaaggaggtgtagtagctgttcaagtttggggcagaggactggattggaacgatcgctgagcctctga

SEQ ID NO: 51 - protein, 237 aa, Arabidopsis thaliana
  misc_feature (1)..(237): Ceres CDNA ID no. 23521525
  misc_feature (1)..(237): Also Known As Ceres GEMINI ID no. 5109G12
  misc_feature (140)..(181): Pfam Name: zf-C3HC4 Pfam Description: Zinc finger, C3HC4 type (RING finger)
METKHLRKLLQLYQACGGEQELTKTVQNVTSSPLTPTPPPQPPSALDSTMALTIFILLVALFFMGFFSVYFRHFADSSSSTVDISSMPRTRSSRMSPRRLSTSVVVSRPYSFRRGLDSQAVRSLPVYRYTKAAKQRNEDCVICLSDFEEGETVKVIPHCGHVFHVDCVDTWLSSYVTCPLCRSNQLFSDKDLGMQEPPDQDSAEEHDTCDGVDTCVRRCSSCSSLGQRTGLERSLSL

SEQ ID NO: 52 - DNA, 2296 bp, Arabidopsis thaliana
  misc_feature (1)..(2296): Ceres CDNA ID no. 23522373
  misc_feature (1)..(2296): Also Known As Ceres GEMINI ID no. 5110H5
atgggtagcagtgagatggaaaaatcaggtaaagagaaagaacctaagactacaccgccttcgacttcttcatctgctcctgctactgttgtttcacaggtttgcttttggtgtaaatttggtctagcaaagtgttttttgttagtgtcatgctttgatgtttaatgttttgtgtttttaggaaccttcttctgctgtgagtgctggagtggctgttactcaagattggtctggcttccaggtctaatacgagattattctttgtttctttgttgcattttggtgttatggggttcatgtttttcttgttgaacaggcttattctcctatgccgcctcatggttatgtagcatcaagtcctcaacctcatccttatatgtggggcgttcaggtaaatcgaatttttttagatgattttaagcattctttggagcttcaggggattagttgacgagtcccaaaacttttactatagatatttgcatacttgggataaattcccttggtcacttgtgtagatttaatcgagattaatattttctaccatatatagtacgttaggttaatgaatgaatgtaacgacaacttaagacattgttatttcctttttgtagcatatgatgccgccttatggaacaccgcctcatccgtatgttacgatgtatcctccaggtggcatgtatgctcatccttcattacctccggtactgttacagtttggatgttcagttatgttactcaaaaaagtgaatgtttttgtagtttctgttaacatgttccgtgctgcaacaggggtcttatccatatagtccctatgcaatgccttctcctaatggaatggctgaagcttctgtgagttttctctgttatcactgtttttattagagtatgggtcagatgggatcttgcttgaagaatgttttggattcagggtaatactggaagtgttattgagggtgatggtaaaccatctgatgggaaggaaaaattgccaatcaaaagatcaaaaggaagcttgggaagtttgaatatgattataggaaagaacaatgaagctggaaaaaactcaggagcatcagctaatggagcttgttctaaaaggcatgtgacttcatatttgtatgaacatcatattggcatgaatacttatgattgctagctctagctatgataatgttattggataattttgttgaaattgtctgatttgttctcggtttaacagtgctgagagcggttctgatggatcaagtgacggaagtgatgcaaattcacaaaacgtaagtttctagcatttcattaaatcgttgcgttggatttcatatgaaaattaaggagcgtttatgaatatggtattgatttttgtaggactctggctctagacacaacgggaaggatggttagctaatatagctttttagttctcatctcttaacatgtaataatgacgtacatgttagaatctgcttattttgaggtttctctttcttgtttcgtaattcaaggtgaaacagcttcagagagtggtggttctgctcatggaccaccccgtaatggaagtaatctaccagtgaaccagaccgtcgctatcatgccagtgtcggctacaggtgttccaggcccaccaacaaatctaaatatcggaatggattattggagcggtcatgggaatgtttctggagcagttcctggagttgtagtagatggttcccaatcacagccatggttacaggtttctgtaagtatctcctaatcttacttctcctttacgtttatccaagcagcgtgtttgattgttttgtgaaatcaggatgagagagagattaagcgacagagacggaagcaatccaatagggaatctgctcgtagatccaggttgcgtaaacaggtaacataaacatgtttcttcaagctgatctagcatcatcatgcctatcaagtatgaatgatcaaaagcttttccttttctcttctgtgttcaggcggagtgtgatgagctagcacaacgagcagaggttttgaatggagagaactcaagtcttagagcagaaattaacaagcttaaaagccaatatgaagagcttcttgctgaaaatagctctctcaaggtaaaagattacaataaaatcttcttctacaacatccataatctgcttgaacataaattgaaagttgctgttttctctggtacccgttgttgcagaataagttctcgtcagccccgtcactggaaggtggagacttggacaagaacgagcaagaaccacagagaagtacacgtcaggatgttgcgtag

SEQ ID NO: 53 - protein, 387 aa, Arabidopsis thaliana
  misc_feature (1)..(387): Ceres CDNA ID no. 23522373
  misc_feature (1)..(387): Also Known As Ceres GEMINI ID no. 5110H5
  misc_feature (1)..(205): Pfam Name: MFMR Pfam Description: G-box binding protein MFMR
  misc_feature (326)..(365): Pfam Name: bZIP_Maf Pfam Description: bZIP Maf transcription factor
MGSSEMEKSGKEKEPKTTPPSTSSSAPATVVSQEPSSAVSAGVAVTQDWSGFQAYSPMPPHGYVASSPQPHPYMWGVQHMMPPYGTPPHPYVTMYPPGGMYAHPSLPPGSYPYSPYAMPSPNGMAEASGNTGSVIEGDGKPSDGKEKLPIKRSKGSLGSLNMIIGKNNEAGKNSGASANGACSKSAESGSDGSSDGSDANSQNDSGSRHNGKDGETASESGGSAHGPPRNGSNLPVNQTVAIMPVSATGVPGPPTNLNIGMDYWSGHGNVSGAVPGVVVDGSQSQPWLQDEREIKRQRRKQSNRESARRSRLRKQAECDELAQRAEVLNGENSSLRAEINKLKSQYEELLAENSSLKNKFSSAPSLEGGDLDKNEQEPQRSTRQDVA

SEQ ID NO: 54 - protein, 368 aa, Arabidopsis thaliana
  misc_feature (1)..(368): Public GI No. 3608135
  misc_feature (1)..(368): Functional Homolog of  Ceres CDNA ID no. 23522373 at SEQ ID NO. 53 with e-value of 3.80E-139 and percent identity of 81.3
MASNEMEKSSKEKEPKTPPPSSTAPPSSQEPSSAVSAGMATPDWSGFQAYSPMPPPHGYVASSPQPHPYMWGVQHMMPPYGTPPHPYVAMYPPGGMYAHPSMPPGSYPYSPYAMPSPNGMTEVSVSGTDGDAKQSEVKEKLPIKRSRGSLGSLNMITGKNNEPGKNSGASANGAYSKSGESASDGSSEGSDGNSQNSSLLFFHSAEAASENGGSANGPQNGSAGTPILPVSQTVPIMPMTAAGVPGPPTNLNIGMDYWGAPTSAGIPGMHGKVSTPVPGVVAPGSRDGGHSQPWLQDDRELKRQRRKQSNRESARRSRLRKQAECDELAQRAEVLNEENTNLRAEINKLKSQCEELTTENTSLKVKKK

SEQ ID NO: 55 - protein, 409 aa, Arabidopsis thaliana
  misc_feature (1)..(409): Ceres CLONE ID no. 1188156
  misc_feature (1)..(409): Functional Homolog of  Ceres CDNA ID no. 23522373 at SEQ ID NO. 53 with e-value of 9.39E-152 and percent identity of 80.3
MASNEMEKSSKEKEPKTPPPSSTAPPSSQEPSSAVSAGMATPDWSGFQAYSPMPPPHGYVASSPQPHPYMWGVQHMMPPYGTPPHPYVAMYPPGGMYAHPSMPPGSYPYSPYAMPSPNGMTEVSGNTTGGTDGDAKQSEVKEKLPIKRSRGSLGSLNMITGKNNEPGKNSGASANGAYSKSGESASDGSSEGSDGNSQNDSGSGLDGKDAEAASENGGSANGPQNGSAGTPILPVSQTVPIMPMTAAGVPGPPTNLNIGMDYWGAPTSAGIPGMHGKVSTPVPGVVAPGSRDGGHSQPWLQDDRELKRQRRKQSNRESARRSRLRKQAECDELAQRAEVLNEENTNLRAEINKLKSQCEELTTENTSLKDQLSLLPPLEGISMDNDHQEPDTNQTGAAERKVDSYKDST

SEQ ID NO: 56 - protein, 409 aa, Arabidopsis thaliana
  misc_feature (1)..(409): Public GI No. 42570366
  misc_feature (1)..(409): Functional Homolog of  Ceres CDNA ID no. 23522373 at SEQ ID NO. 53 with e-value of 1.19E-151 and percent identity of 80.3
MASNEMEKSSKEKEPKTPPPSSTAPPSSQEPSSAVSAGMATPDWSGFQAYSPMPPPHGYVASSPQPHPYMWGVQHMMPPYGTPPHPYVAMYPPGGMYAHPSMPPGSYPYSPYAMPSPNGMTEVSGNTTGGTDGDAKQSEVKEKLPIKRSRGSLGSLNMITGKNNEPGKNSGASANGAYSKSGESASDGSSEGSDGNSQNDSGSGLDGKDAEAASENGGSANGPQNGSAGTPILPVSQTVPIMPMTAAGVPGPPTNLNIGMDYWGAPTSAGIPGMHGKVSTPVPGVVAPGSRDGGHSQPWLQDDRELKRQRRKQSNRESARRSRLRKQAECDELAQRAEVLNEENTNLRAEINKLKSQCEELTTENTSLKDQLSLFPPLEGISMDNDHQEPDTNQTGAAERKVDSYKDST

SEQ ID NO: 57 - DNA, 1998 bp, Arabidopsis thaliana
  misc_feature (1)..(1998): Ceres CDNA ID no. 23529806
  misc_feature (1)..(1998): Also Known As Ceres GEMINI ID no. 5110F11
atggagactgcgactggagaaatcaccatcgtctgcaaccactggtttgtttcccccctaaaaccattgatttctctgtctgtggttgttgacttgtttctatttgatcatagtttttttcggcgattggttgctttctctttgttgcgtaatcgttcgatgatgacttgtgtaattcgatattctggactcgaggttataacaattttggaattgatcggtgattgcaattgagaatatgtgtcacattaaagatactcgtgagctgtatgattcagtttggttccacggtttgtgtcggtgattacaagtataactagggattcgatggatggattagtgatatacaatctttttttctaaaagagttcatttttatttggtcacctactaaaaggttgattcttttttgttactttgcttaaagtccttcatgataaatctattgattatgtatcagcttcctggtgtctgtacaagagttttattgtcttctgtttatcgtcatgctttctacgatttgtctgatggtttgcttagtttctaaactttctaaagatatatgtgtatgctttgtctagttattgttgtgttgagtctgctgaggctggaaatttttgaatgccctaattcttatttgggatcagtaaatctaatcccttgtgtatgttcagtggtagcatttacctggatggttgatcccatgagactgattatcttaatgttttcagtgacagagacattccatcactgaatatcgatctgcatcgtgtacattgtgctcggaatttagaaaaatgtaagatttgtggtgatatggtacccaaaaagcatgctgaggaacactacttgaacacacatgctccggtacactgatttctctgtttcttacttgttgttaaactgttttctgtttgattaatttccacaactgtcatctttgatgtgaagagcttctctttgttagctccatcaaaattatatactttgtctagtgtgacgtccaaataggttgatcaaagggatttacattgtttcatatgataggattctgctctcaaatattttgttaatgtccctccaacgggttttaagcttgtttcaattaacaaatattagatcacttatgcatttattagactttttaacttagtgtgtaacacaaacagctagttatcaacgcttgttcctgactgttcttgagttttatggttgacaagaactcccccaagcgcagcttgtgtttgcaaggttgtgactgtttcaattactaggtcgagaatagttattcagtataacaagtaggaatttgttttgtttctgttttagactcaggatttttgtatggcctagatgctgctagatgactgaaatgacctacattttcttacgaaattctttctgttctgtattgagaagatagcatgctcgatgtgcaaagagaccatagaacgtgagattttcgatagtcataaaggagaaatttgccccaagaggattgtaacatgcgagttctgtgagtttccattgcctgcggttgatcttgccgagcatcaggtattcactctgacttgcacacttccttttctctccaactaaaggattttctgatccgctcgattttccgaatattaggaagtatgtggcaacaggacagaactctgttatcaatgcaacagctatgttagattgagagaaagatataaccatgaaaccaaatgccctggcactgttgaatcatccaggtacattttcttatcttcattgttttattttgaaaactctctgattcagatcttaatccttttttatttggctaaactcatgtcatgacatggattgtacagaaggatcccgagagcagcagaaggagatggaaacgggagaagacgaagagatgggaacggtgtttcgaacaaaaggcttttcttcacgatagcaataacgggaatagctgtgataataggatccttgttcttccagaggaagcctgagtag

SEQ ID NO: 58 - protein, 192 aa, Arabidopsis thaliana
  misc_feature (1)..(192): Ceres CDNA ID no. 23529806
  misc_feature (1)..(192): Also Known As Ceres GEMINI ID no. 5110F11
  misc_feature (78)..(116): Pfam Name: zf-TRAF Pfam Description: TRAF-type zinc finger
METATGEITIVCNHCDRDIPSLNIDLHRVHCARNLEKCKICGDMVPKKHAEEHYLNTHAPIACSMCKETIEREIFDSHKGEICPKRIVTCEFCEFPLPAVDLAEHQEVCGNRTELCYQCNSYVRLRERYNHETKCPGTVESSRRIPRAAEGDGNGRRRRDGNGVSNKRLFFTIAITGIAVIIGSLFFQRKPE

SEQ ID NO: 59 - protein, 192 aa, Arabidopsis thaliana
  misc_feature (1)..(192): Public GI No. 21593788
  misc_feature (1)..(192): Functional Homolog of  Ceres CDNA ID no. 23529806 at SEQ ID NO. 58 with e-value of 2.20E-102 and percent identity of 97.3
  misc_feature (150)..(150): Xaa is any aa, unknown, or other
  misc_feature (158)..(158): Xaa is any aa, unknown, or other
  misc_feature (159)..(159): Xaa is any aa, unknown, or other
  misc_feature (188)..(188): Xaa is any aa, unknown, or other
METATGEITIVCNHCDRDIPSLNIDLHRVHCARNLEKCKICGDMVPKKHAEEHYLNTHAPIACSMCKETIEREIFDSHKGEICPKRIVTCEFCEFPLPAVDLAEHQEVCGNRTELCYQCNSYVRLRERYNHETKCPGTVESSRRIPRAAXGDGNGRRXXEGNGVSNKRLFFTIAITGIAVIIGSLFFXRKPE

SEQ ID NO: 60 - protein, 197 aa, Brassica napus
  misc_feature (1)..(197): Ceres CLONE ID no. 969293
  misc_feature (1)..(197): Functional Homolog of  Ceres CDNA ID no. 23529806 at SEQ ID NO. 58 with e-value of 7.69E-93 and percent identity of 90.0
  misc_feature (189)..(189): Xaa is any aa, unknown, or other
MATETGEITIVCNHCDRDIPAPNIDLHRVHCARNLEKCKICGDMVPKKHAEEHFLNTHAPVPCSMCKETIDREVFNSHTEEICPKRMVTCEFCEFPLPAVDLAEHQEVCGNRTELCYQCNSYVRLRETYNHETKCPGSVXNTVESSRRIPRAAEGDGNGRRRRDNGVXNKRLXFXIAITGIAVLIGSLXFQRKPEGS

SEQ ID NO: 61 - protein, 202 aa, Glycine max
  misc_feature (1)..(202): Ceres CLONE ID no. 852336
  misc_feature (1)..(202): Functional Homolog of  Ceres CDNA ID no. 23529806 at SEQ ID NO. 58 with e-value of 6.20E-68 and percent identity of 66.1
  misc_feature (192)..(192): Xaa is any aa, unknown, or other
MEAVSDQDTSICTHCDRAIPAANIDLHYAHCSRKLEKCKVCGDMVPRKNAEDHYLSTHAPVSCSLCSETMERDILDIHKGENCPQRIVTCQFCEFPLPAIDLAEHQEVCGNRTELCHLCNKYVRLRERFSHEARCNGIQDSSVGTSRNVREAEREQGARRRPLPXQNDXSTKRLLFTIAITGIAVILGSFFXQRKADPSDVH

SEQ ID NO: 62 - protein, 210 aa, Zea mays
  misc_feature (1)..(210): Ceres CLONE ID no. 234649
  misc_feature (1)..(210): Functional Homolog of  Ceres CDNA ID no. 23529806 at SEQ ID NO. 58 with e-value of 5.80E-56 and percent identity of 61.0
MAAAAADSDTAAAVGAMSTCAHCQREIPFLNIDLHSVHCARNLQKCQHCGEMIPRKLMDEHYDENHAPINCSLCKETIERESWDLHKGEKCPQRIVACEYCEFELPAVDLHEHQDVCGNRTELCQTCRKYIRLREWTGHEIQCHTNSNGSADTSRAIPERELRPPPPPVRQARPARPAHASPHKRLLFTIAVTGIAVMIGSILFQRDEGF

SEQ ID NO: 63 - protein, 211 aa, Zea mays
  misc_feature (1)..(211): Ceres CLONE ID no. 460881
  misc_feature (1)..(211): Functional Homolog of  Ceres CDNA ID no. 23529806 at SEQ ID NO. 58 with e-value of 3.29E-53 and percent identity of 60.6
MAAAAADSDPAAAVADMSTCAHCQREIPSSNIDLHSVHCARNLQKCQHCGEMIPRKLMDEHYDANHAPISCSLCKETIERVRWDLHKGEKCPQRIVACEYCEFELPAVDLHEHQDVCGNRTELCQTCRKYIRLCEWIGHEIQCHTSSNGXADTSSARAIPERELRPPPPVRPARPARPAHXSPHKRLLFTIAVTGIAVMVGSILFQRDESF

SEQ ID NO: 64 - protein, 208 aa, Oryza sativa subsp. japonica
  misc_feature (1)..(208): Public GI No. 50939745
  misc_feature (1)..(208): Functional Homolog of  Ceres CDNA ID no. 23529806 at SEQ ID NO. 58 with e-value of 5.49E-44 and percent identity of 48.0
MAAAAADSADPVITTATCAHCHREIPSPNIALHSAHCARNLQKCEHCGYMVPKKLMDEHYDENHAPMICSLCQKTVQRELWDLHKGLQCPQRMLACQYCDFELPAADIYEHQDVCGNRTEYCQPCRKYVRLREQIGHDIQFHSQPIVASESSSDRSTLEEEESYPAEEQPVRPKHTHGLQRKQFLVTIVIAGISILVGSVLLKKGWLS

SEQ ID NO: 65 - DNA, 1072 bp, Arabidopsis thaliana
  misc_feature (1)..(1072): Ceres CDNA ID no. 23530574
  misc_feature (1)..(1072): Also Known As Ceres GEMINI ID no. 5110H2
atggctggaggaagtaaatcaccggcgtcatctttggaagatggaaaggcatacgtcaatgctgtgaaggtcgcattggaggaagcggaacctgcaaaatatcaagagtttctaagactctttcatgaggtgatagcgcgaaggtgtgtttggtttgctcttaaacagtctaaagaacaaagacacatgtgagaattgattctaatgttatttttatctttgtaggatgggtatggctactttcagtgcacgcatgcaggacctcttgaaagatcacccgagtctgtgtcttggtttaaatgtcatgcttgcacctgagtatcagagagccatccctcccgaggctagcgaagagtttcataaggtggttggaagaagcgtaccacgtccggagcctaccatagatgatgcgacttcatacctcattgctgtgaaggaagcatttcatgatgaacctgcaaaatatgaggaaatgcttaagctcttgaatgattttaaagctcgcaggtatgtattagttcttttctccatgttatgtttgattttctcagtctacagaacaaatacattatgtaaattgattctgatgttactaagtctctttgtagagtcaatgccgctagtgtcattgctagggtggaggaactcatgaaagatcactcgaatctgctttttggtttctgtgtcttcctttcagctacaacgagttttaccacgaagcttaaggtatagagtgcttataggtaccatttgatatttcctatatgttcacttgcggtttaagtaacaaaattgtccatatgcaggcaaagtttcagggcgatggtagtcaagtagttgactcagttcttcagataatgagaatgtacggtgagggaaacaagtccaaacatgatgcgtatcaggaggtaggcttcttggtaggatactttgtgttgtgtgttgcactttcttagttctttggtttcatttgctttgttatcttttgcagatcgttgcacttgttcagggtcatgacgatttagtcatggagctttcacaaattttcactgatccatctactagagtctag

SEQ ID NO: 66 - protein, 241 aa, Arabidopsis thaliana
  misc_feature (1)..(241): Ceres CDNA ID no. 23530574
  misc_feature (1)..(241): Also Known As Ceres GEMINI ID no. 5110H2
  misc_feature (189)..(235): Pfam Name: PAH Pfam Description: Paired amphipathic helix repeat
MAGGSKSPASSLEDGKAYVNAVKVALEEAEPAKYQEFLRLFHEVIARRMGMATFSARMQDLLKDHPSLCLGLNVMLAPEYQRAIPPEASEEFHKVVGRSVPRPEPTIDDATSYLIAVKEAFHDEPAKYEEMLKLLNDFKARRVNAASVIARVEELMKDHSNLLFGFCVFLSATTSFTTKLKAKFQGDGSQVVDSVLQIMRMYGEGNKSKHDAYQEIVALVQGHDDLVMELSQIFTDPSTRV

SEQ ID NO: 67 - protein, 252 aa, Arabidopsis thaliana
  misc_feature (1)..(252): Public GI No. 7486367
  misc_feature (1)..(252): Functional Homolog of  Ceres CDNA ID no. 23530574 at SEQ ID NO. 66 with e-value of 6.60E-103 and percent identity of 87.1
MAGGSLSPASSLEDVKAYVNAVEVALQEMEPARFGMFVRLFRGFTAPRIGMPTFSARMQDLLKDHPSLCLGLNVLLPPEYQLTIPPEASEEFHKVVGRSVPVPPKVVGRSLPRPEPTIDDATSYLIAVKEAFHDEPAKYGEMLKLLKDFKARRVDAACVIARVEELMKDHLNLLFGFCVFLSATTSFTTKLKARFQGDGSQVVDSVLQIMRMYGEGNKSKHDAYQEVVALVQGHDDLVMELSQILTDPPTGV

SEQ ID NO: 68 - DNA, 393 bp, Arabidopsis thaliana
  misc_feature (1)..(393): Ceres CDNA ID no. 23538950
  misc_feature (1)..(393): Also Known As Ceres GEMINI ID no. 5109B2
atggtgaacgaaacagaagcattaccatgcgagggaggctgtggactctacggcacccgagtgaacaacaatctatgctctctctgctacaaaaagagtgttcttcaacactcgcccgctttaagattcgaacccgagaccgagcaatcacagtgttgccctcctacgaatagtcccgccgttgaagaagaaccggtcaaaaaaaggagatgtgggatatgtaagaggaaggtaggaatgttgggattcaagtgtagatgtggacacatgttttgcgggtcacatcgttatccggaggagcattcttgtccctttgattacaaacaatctggacggctcgccttggccacacagttgcctttgatcagagctgacaagttgcagaggttttag

SEQ ID NO: 69 - protein, 130 aa, Arabidopsis thaliana
  misc_feature (1)..(130): Ceres CDNA ID no. 23538950
  misc_feature (1)..(130): Also Known As Ceres GEMINI ID no. 5109B2
  misc_feature (7)..(31): Pfam Name: zf-A20 Pfam Description: A20-like zinc finger
  misc_feature (71)..(111): Pfam Name: zf-AN1 Pfam Description: AN1-like Zinc finger
MVNETEALPCEGGCGLYGTRVNNNLCSLCYKKSVLQHSPALRFEPETEQSQCCPPTNSPAVEEEPVKKRRCGICKRKVGMLGFKCRCGHMFCGSHRYPEEHSCPFDYKQSGRLALATQLPLIRADKLQRF

SEQ ID NO: 70 - DNA, 2463 bp, Arabidopsis thaliana
  misc_feature (1)..(2463): Ceres CDNA ID no. 23544617
  misc_feature (1)..(2463): Also Known As Ceres GEMINI ID no. 5110D6
atgacaactgaagatcagacaatttcaagtagtggaggatatgtccaaagctcatcaacaactgatcatgttgatcatcatcatcatgatcaacatgaatccctcaatcctcctcttgtcaagaagaagagaaacctccctggaaatcctggtaacaattaattaagtttaatagagatcacaaaataattcaaccctaatcaacatttttttttctgtttgctgaaaagtcatgttcttttttttttcgatcttgatctacaaacatgcatgctttctactgtttagatctttcacatgatcaaatatgtatccagaatttgattgttatatttcgttctctatagatccagaagctgaggtcatagctctatctccaaagacacttatggccacaaatcgtttcctctgcgagatatgtggaaaagggtttcaaagagaccagaatctacagcttcaccgtcgaggacacaacctcccatggaagctaaagcagaggacgagcaaagaagtaaggaaacgagtgtatgtatgtccagaaaagagttgcgtccaccaccatccgacgagggcacttggtgatcttaccggcattaagaaacatttttgtcggaaacatggcgagaaaaagtggaagtgtgagaaatgcgccaagagatatgcagtccaatctgactggaaggctcattccaagacttgtgggactagagaatatagatgcgactgtggtacaattttctccaggtacttagtgtatatctacacacgtacgtactaatagatgatctttacatttcctcatcacggtatcatatatttttagtggcgtaacaaatattttgatcacctagctgtaagcgcatatcatgtttaattgcattatatatagattcaaatatgattttaacttcttaaccagtaaagttaatcatgtttgaatatattagaatataggaagaatatatatatacttatatacatatcttaaaactcatactaaacctagctagagcttatattttaccgggtgaatactatgatgaaaaacaaaaaaaaaacgaatctgttacctcaactaacactactgtaccactggaccacacaaacaaatttcgttttaccacgttgtttgtaagtaaataagatttttttttttttttttgtgaaacaatttgtaagtaaataagatacatgttttttgttggaagtagtagctcatgtagggtctaaaacaaaataatttggagttacttttgtatagatattgccatattggtcattctctgagcatacgtgctgcttgatttcttgaataagacagtttcttggattgacatattttggttaaagtaagatatacaactttatttatctttttttccttaattgctatctatattactatatacatacatattaaacacaagcataaattagcgagtgtgtatagacgatattgatcttattggtgtgtataatttggtcaacaggagagacagcttcattacacatagagcgttctgtgacgctttagcagaagaaaccgctaggctaaacgcagcctcgcatctcaaaagctttgccgcaaccgctggtagtaatctaaactatcattatctcatggggacacttatcccatcaccatcactaccacaaccaccgtcgtttccgttcggaccaccgcaaccgcaacatcatcaccaccaccaattcccaatcacaaccaacaacttcgatcatcaagacgtcatgaaaccagcgtctacgctctctttatggtcgggaggaaatattaatcatcatcagcaagtgaccatcgaggaccgtatggcgccgcagccgcattcaccgcaagaggattacaattgggttttcggaaacgcgaataatcacggcgagttaataacgacgagcgattcactcattactcatgacaataatattaatatcgtccagagtaaggaaaacgctaacggggcaacttctctttccgtgccttctctttttagcagcgttgaccaaattacccaagacgcaaacgctgcttctgtggctgttgcaaatatgtcggcgactgcgttactccaaaaagctgctcagatgggagcgacttcttctacgtcaccaacgacgacgattactaccgaccaatcagcgtatcttcagagttttgcatcgaagagtaatcagattgtagaagatggtggcagcgacaggttctttgcttcgtttggatcgaacagtgtcgagttaatgagtaataataataacggtcttcacgagatcgggaaccctagaaacggcgttacggtcgtttcggggatgggtgaattacagaattacccttggaagcgtagaagagttgatattgggaatgcgggaggaggagggcaaactcgggattttcttggggttggtgtacaaacaatatgccattcttcctctatcaatggatggatttga

SEQ ID NO: 71 - protein, 506 aa, Arabidopsis thaliana
  misc_feature (1)..(506): Ceres CDNA ID no. 23544617
  misc_feature (1)..(506): Also Known As Ceres GEMINI ID no. 5110D6
  misc_feature (70)..(92): Pfam Name: zf-C2H2 Pfam Description: Zinc finger, C2H2 type
MTTEDQTISSSGGYVQSSSTTDHVDHHHHDQHESLNPPLVKKKRNLPGNPDPEAEVIALSPKTLMATNRFLCEICGKGFQRDQNLQLHRRGHNLPWKLKQRTSKEVRKRVYVCPEKSCVHHHPTRALGDLTGIKKHFCRKHGEKKWKCEKCAKRYAVQSDWKAHSKTCGTREYRCDCGTIFSRRDSFITHRAFCDALAEETARLNAASHLKSFAATAGSNLNYHYLMGTLIPSPSLPQPPSFPFGPPQPQHHHHHQFPITTNNFDHQDVMKPASTLSLWSGGNINHHQQVTIEDRMAPQPHSPQEDYNWVFGNANNHGELITTSDSLITHDNNINIVQSKENANGATSLSVPSLFSSVDQITQDANAASVAVANMSATALLQKAAQMGATSSTSPTTTITTDQSAYLQSFASKSNQIVEDGGSDRFFASFGSNSVELMSNNNNGLHEIGNPRNGVTVVSGMGELQNYPWKRRRVDIGNAGGGGQTRDFLGVGVQTICHSSSINGWI

SEQ ID NO: 72 - DNA, 930 bp, Arabidopsis thaliana
  misc_feature (1)..(930): Ceres CDNA ID no. 23544687
  misc_feature (1)..(930): Also Known As Ceres GEMINI ID no. 5109C3
atggagaattcttacgactcaagcaagtggtctgattctacaactccatatatggtctcgtggtcactacaatctgagtcctctgattctgattggaaccggtttaatcttggcttctcttcttcctccttcggtggtaatttcccggctgatgattgtgtcggtgggatcgaaaaagctgagtcactttcaagaagccaccgtctagcggagaaaagacgccgtgaccggataaattctcacctcactgctctccggaaacttgtccccaattccgacaaggtatgtatgactctcacaactgaaatactctcggttcagtcatgaaacttcaatttgagcaaaccggtttatatctgatttcggttaaagaatttttaattcgagttgaccggtttattttctagctgggttatgtaaaccgattttgacttgactctactgcagttagacaaagcagctctattagcaacagtgattgaacaagtgaaagaactcaaacaaaaagcagcagaatcaccaatcttccaagatcttccaacagaagcagatgaagtaactgtacagcctgaaactatctctgactttgaatcaaacacaaacacaatcatcttcaaagcttctttttgctgcgaagatcaacccgaagcaatctcagagattattagagttctcacaaagcttcaactcgaaacaatccaagcagagataatctctgttgggggaagaatgagaatcaatttcatcttaaaagatagcaactgcaatgagactacaaacatagctgcttcagcaaaagctttgaagcaatctctctgctctgcgttaaatcgaatcacatcttcttctacgactacttcttcagtttgcagaatcagaagtaaaagacagagatggttcctctcttctcattattctcacaatgaataa

SEQ ID NO: 73 - protein, 254 aa, Arabidopsis thaliana
  misc_feature (1)..(254): Ceres CDNA ID no. 23544687
  misc_feature (1)..(254): Also Known As Ceres GEMINI ID no. 5109C3
  misc_feature (63)..(112): Pfam Name: HLH Pfam Description: Helix-loop-helix DNA-binding domain
MENSYDSSKWSDSTTPYMVSWSLQSESSDSDWNRFNLGFSSSSFGGNFPADDCVGGIEKAESLSRSHRLAEKRRRDRINSHLTALRKLVPNSDKLDKAALLATVIEQVKELKQKAAESPIFQDLPTEADEVTVQPETISDFESNTNTIIFKASFCCEDQPEAISEIIRVLTKLQLETIQAEIISVGGRMRINFILKDSNCNETTNIAASAKALKQSLCSALNRITSSSTTTSSVCRIRSKRQRWFLSSHYSHNE

SEQ ID NO: 74 - protein, 279 aa, Glycine max
  misc_feature (1)..(279): Ceres CLONE ID no. 474183
  misc_feature (1)..(279): Functional Homolog of  Ceres CDNA ID no. 23544687 at SEQ ID NO. 73 with e-value of 4.59E-40 and percent identity of 43.9
  misc_feature (265)..(265): Xaa is any aa, unknown, or other
  misc_feature (271)..(271): Xaa is any aa, unknown, or other
  misc_feature (272)..(272): Xaa is any aa, unknown, or other
  misc_feature (279)..(279): Xaa is any aa, unknown, or other
MESYYYSGWPLAQFNSAPNSDQLSPFSVPTTTQQTLPLVATSTSDRAAAASLQFGEFPSWPAPIAAEDRAASASKSHSQAEKRRRDSINAQLATLRKLIPMSDKMDKATLLGSVVDHVKDLKRKAMDVSKAITVPTETDEVTIDYHQAQDESYTKKVNILKENIIIKASVCCDDRPELFPELIQVLKGLRLTAVKADIASVGGRIKSILVLCSKDSEENNSVCLSTLKQSLKSAVNKIASLSVATNCPTRSKRQRFFLPSHYVQXFIAIFXXIFVFNSX

SEQ ID NO: 75 - DNA, 774 bp, Arabidopsis thaliana
  misc_feature (1)..(774): Ceres CDNA ID no. 23544992
  misc_feature (1)..(774): Also Known As Ceres GEMINI ID no. 5110B1
atggacgaaaccaacggacgaagagaaactcacgatttcatgaacgtcaacgttgaatccttctctcagcttcctttcatccgccgtactcctcccaaagaaaaagccgccattattcgtctcttcggccaagagctcgtcggtgataactccgacaacttatccgcagaaccttctgatcatcaaaccactaccaagaacgatgagagctctgagaatatcaaggacaaagacaaagaaaaagataaggacaaagacaaagataacaacaacaacaggagattcgagtgtcactactgcttcagaaacttcccaacttctcaagccctaggtggacatcaaaacgctcacaaacgtgaacgtcaacacgccaaacgcggttccatgacatcataccttcatcatcatcagcctcatgaccctcaccacatctacggcttcctcaacaaccaccaccaccgtcactatccgtcttggacgacggaagctagatcatactacggcggagggggacatcaaacgccgtcgtactactcaaggaatactcttgctcctccttcttctaacccaccgacaatcaacggaagtcctttaggtttgtggcgtgtaccgccttccacgtcaacaaatactattcaaggcgtttactcatcttcaccagcttcagcgtttaggtcgcatgagcaagagactaataaggagcctaataactggccgtacagattgatgaaacccaatgtgcaagatcatgtgagtctcgatcttcatctctga

SEQ ID NO: 76 - protein, 257 aa, Arabidopsis thaliana
  misc_feature (1)..(257): Ceres CDNA ID no. 23544992
  misc_feature (1)..(257): Also Known As Ceres GEMINI ID no. 5110B1
MDETNGRRETHDFMNVNVESFSQLPFIRRTPPKEKAAIIRLFGQELVGDNSDNLSAEPSDHQTTTKNDESSENIKDKDKEKDKDKDKDNNNNRRFECHYCFRNFPTSQALGGHQNAHKRERQHAKRGSMTSYLHHHQPHDPHHIYGFLNNHHHRHYPSWTTEARSYYGGGGHQTPSYYSRNTLAPPSSNPPTINGSPLGLWRVPPSTSTNTIQGVYSSSPASAFRSHEQETNKEPNNWPYRLMKPNVQDHVSLDLHL

SEQ ID NO: 77 - DNA, 2133 bp, Arabidopsis thaliana
  misc_feature (1)..(2133): Ceres CDNA ID no. 23546315
  misc_feature (1)..(2133): Also Known As Ceres GEMINI ID no. 5109F1
atggatgagggagatgggagagatcagatggatcaatttcatcaaaacgaggcgatatctgccgttgctgacgacgggtttatggcggaggaagaggatgatgattatgaggatctttataacgacgttaatgttggagaagggtttcttcagtctatgaaaaagaacgacgaagcgggatctagaaacgaggaaaaggagaaggttaatatggaggaggaagatagggttgaaccagttttaggtgaagctgaggtttcgatttcgatacctggtttggttggtgagagcgttgagaaagaagcagaagcagagtcaggaggaggaggaagtggaagtggtactgatgtggtggtcgcttctagtggatatggagctcaggaggttaaggtaagcgatgttagccaggagattcctggtggaattggtactggtactggaggtgggctgagagttgagctagggcaagcttctaatcgggctaatgatctcgaggcacctagagggaataatatttcgcagggtctcttgccaccaccgcctgtgttggggaataacgagaatttgatgagacctgtgatgggtaatgttaatggcgggattcctcctggacctggtagtaacatggttgggaacggagctaatatcgctatgcctggtgttgttggcgggggaactggtggtggaggaggcggtggagcttttcttttcgtaggggatctgcattggtggacaactgatgcggagcttgaggcagagttgtgcaagtatggtgcagtgaaggaggttaagttctttgatgagaaagctagtgggaagtcgaaagggtattgtcaagtagagttctatgatcctgtggcagcttcggcttgcaaagatgcgctgaatgggtatccattcaacggtaggccttgtgttgttgagtatgcgtccccatattcggttaagagaatgggagaggcacaggtgaataggacccaacaggctcaatctgtaattgcacaagctaagagaggagggcctgctgatcctccaagtaaaccactcgtggccaacaacaacaataacaacaacaacaacgccattggcgggaatttccaaggtggggaaaatagaggatttggtagaggtaattggggtagaggcaatgctcaaggaatgggtggtagaggaccaggtggtccaatgaggaataggcctaatgggatgggtggaagaggtttgatgggtaatggtgggtttggtcaaggaatgggtacagggcctcctatgaatatgatgcatcaaccaatgatggggcaagggtttgaacaagcttttggtggaccgatggcgagaatgggagggtatggaggattccctggggctccaggtccacagtttcctgggcttttgtcatcattccctcctgtaggaggagttggtttacctggagtggcacctcatgtgaatccagcattttttggacgagggatgccgatgaatggaatgggaatgatgcctaatgctggtgttgatggagggcataatatgggaatgtgggatcctaacagtggagggtggggtgctggtgaagatctgggtagtggaagagctgcggaatcgagttatggggaggaagctgcatctgatcatcagtatggagaggttaatcacgaaagaggggctcgtccaaatcctgtgaaggaaaaagaaagagcttcagaaagggaatggtctggttcatctgatagaaggaatcgtgaggataaagatgctggttatgaaagggacataccgagggagaaagatgttggtcacggttatgatatgccagagagaaggcatcgtgatgatagagacaccggtcgtgagcgtgagagggaacatcatcataaggatcgtgaacgctccagagaacatgttcgtgacagagaaagggaaagggagagggatcgtcatagagaagaacgagaacgatatggtggtgatcatcgtactagacacagggacgaacctgaacatgatgaggaatggaacagaggccgatcatccagaggacacaacaaatcgcggttgtctcgcgaggataaccatcgctcaaaatcaagggatactgattatgggaaaagaaggcggcttactactgaatga

SEQ ID NO: 78 - protein, 711 aa, Arabidopsis thaliana
  misc_feature (1)..(711): Ceres CDNA ID no. 23546315
  misc_feature (1)..(711): Also Known As Ceres GEMINI ID no. 5109F1
  misc_feature (236)..(307): Pfam Name: RRM_1 Pfam Description: RNA recognition motif. ( a.k.a. RRM, RBD, or RNP domain)
MDEGDGRDQMDQFHQNEAISAVADDGFMAEEEDDDYEDLYNDVNVGEGFLQSMKKNDEAGSRNEEKEKVNMEEEDRVEPVLGEAEVSISIPGLVGESVEKEAEAESGGGGSGSGTDVVVASSGYGAQEVKVSDVSQEIPGGIGTGTGGGLRVELGQASNRANDLEAPRGNNISQGLLPPPPVLGNNENLMRPVMGNVNGGIPPGPGSNMVGNGANIAMPGVVGGGTGGGGGGGAFLFVGDLHWWTTDAELEAELCKYGAVKEVKFFDEKASGKSKGYCQVEFYDPVAASACKDALNGYPFNGRPCVVEYASPYSVKRMGEAQVNRTQQAQSVIAQAKRGGPADPPSKPLVANNNNNNNNNAIGGNFQGGENRGFGRGNWGRGNAQGMGGRGPGGPMRNRPNGMGGRGLMGNGGFGQGMGTGPPMNMMHQPMMGQGFEQAFGGPMARMGGYGGFPGAPGPQFPGLLSSFPPVGGVGLPGVAPHVNPAFFGRGMPMNGMGMMPNAGVDGGHNMGMWDPNSGGWGAGEDLGSGRAAESSYGEEAASDHQYGEVNHERGARPNPVKEKERASEREWSGSSDRRNREDKDAGYERDIPREKDVGHGYDMPERRHRDDRDTGREREREHHHKDRERSREHVRDRERERERDRHREERERYGGDHRTRHRDEPEHDEEWNRGRSSRGHNKSRLSREDNHRSKSRDTDYGKRRRLTTEE

SEQ ID NO: 79 - DNA, 1555 bp, Arabidopsis thaliana
  misc_feature (1)..(1555): Ceres CDNA ID no. 23557940
  misc_feature (1)..(1555): Also Known As Ceres GEMINI ID no. 5111B1
atggctagctccaagggatcacagagtgttagaaacttgatgtacccgggaaagcatgctttgctcccaccaaaaataccgtttcctagtgtatcagcatcgtattccgagtatattcctactggtttgattggttcaagacatggtcagaagcttagtaatgagaaaacacatcaccagcgaacttcctccgagagccatttggtagaagagcttcccttttggcttgatgatcttctcaatgagcagccggaaagccctgctcgaaaatgtggtcatcggcgttcatcaagtgactcttacgcttatctagatgtggctaatgctacaaacataagtttgactctccaaaatgatttcagttataggaatactgttttatccactcaaagaggagtccaagagcttgaccggaataaaaatgctcaggatgctgccttctactctggtgctagttttctgaaacagaagagtcgtcagcgggattctttggtggcaactggggcttgtccttcttggttacctttcgctcgtgagaacggtggcggaaaaaacttgggagctttatatatgtctcaagatgcaacagtaatatcgtcagaaagaaagaactatgctgaacctttttctcatgacccaaagatgttatcttctgaggaaaacaactccaatccttcgcctgtgacttatgaagctgacaacacaaaacgagccaaacagtttgtgatctctttactcgttcttgattgatgtacctattcaaagcaatatagaatgatcagtactcatttagtttgctgctccctgcaggcaatttgcacaaagatcacgggtccgtaagctccagtacatatctgagctagaaagaaatgtacagacattgcaggtaaggctcaaaaaaacttgcattcaaagagagagtaagtgaaagatgtagtagattacaatttgtgcagcactgaagtatggattttattttgtgactataggcagaaggctccaaagtttcagctgaacttgattttctcaaccagaggaatcttattctgagtatggaaaataaagctctcaagaagcgtctcgaaagtatagctcaggagaagcttatcaaacaatgtaagtttctcgcagtttcttttaggttcttaaggttcaaactatagtctagagtatgagtttgtaagtattagctagttatcaagattcaacagttcttaagattgtatacctcatgagttctgtctattatccagtggaacaagaagtgttggaaaaggagattgggagactacgagcgttgtatcagcaacaacaacaaactcaaaaaccatcagccagtcgcggacgtgctactagcaaagatctcgactctcagttctccagtctttcactgaacaccaaagattccaactgtaggcgtgactctgtatctgtgatgggtcaattccacttttagtaaatgtctctctacccactggttcattagagatcttaagggcctggcgactcaacaagatcagacccttatctaccgcctcaccacagacgtttttaa

SEQ ID NO: 80 - protein, 391 aa, Arabidopsis thaliana
  misc_feature (1)..(391): Ceres CDNA ID no. 23557940
  misc_feature (1)..(391): Also Known As Ceres GEMINI ID no. 5111B1
  misc_feature (243)..(291): Pfam Name: bZIP_1 Pfam Description: bZIP transcription factor
MASSKGSQSVRNLMYPGKHALLPPKIPFPSVSASYSEYIPTGLIGSRHGQKLSNEKTHHQRTSSESHLVEELPFWLDDLLNEQPESPARKCGHRRSSSDSYAYLDVANATNISLTLQNDFSYRNTVLSTQRGVQELDRNKNAQDAAFYSGASFLKQKSRQRDSLVATGACPSWLPFARENGGGKNLGALYMSQDATVISSERKNYAEPFSHDPKMLSSEENNSNPSPVTYEADNTKRAKQQFAQRSRVRKLQYISELERNVQTLQAEGSKVSAELDFLNQRNLILSMENKALKKRLESIAQEKLIKQYSTVLKIVYLMSSVYYPVEQEVLEKEIGRLRALYQQQQQTQKPSASRGRATSKDLDSQFSSLSLNTKDSNCRRDSVSVMGQFHF

SEQ ID NO: 81 - protein, 376 aa, Glycine max
  misc_feature (1)..(376): Ceres CLONE ID no. 475730
  misc_feature (1)..(376): Functional Homolog of  Ceres CDNA ID no. 23557940 at SEQ ID NO. 80 with e-value of 3.09E-89 and percent identity of 55.2
MANSKGSSSFRNFMYPGKHPLLPPKSPFPSVSQAYADYVPNPAVGLKAGNRPRDGNTHHQRTSSESLVIEEQPSWLDDLLNEPETPVRRGGHRRSSSDSFAYIDTVNASNLNYASQDEYKYKNMMSIPPWSPQDFDCSKDARHVPVYAEMNSTKQKNRSWDSFSNAMTNPVGVPSGKDSAAFQSSGLQCTPHEADALPPAASEKHDSVELGLQDAKSFPEKKDISHAKSSASETDTKRAKQQFAQRSRVRKLQYIAELERNVQALQAEGSEVSAELEFLNQQNLILSMENKALKQRLENIAQEQLIKYLEQEVLEREIGRLRALYQQQQQPPQTQPQQQPSGSHRRSNSRELESQFANLSLKHKDTNSGQDPALRI

SEQ ID NO: 82 - protein, 348 aa, Zea mays
  misc_feature (1)..(348): Ceres CLONE ID no. 1534270
  misc_feature (1)..(348): Functional Homolog of  Ceres CDNA ID no. 23557940 at SEQ ID NO. 80 with e-value of 2.00E-53 and percent identity of 49.5
MMANGRFQKQALLPPRSPFPVAAPHAELGPIARPRETPHRHGHQRTSSESFLADEQPSWLDDLLDEPETPARAHGRPGHRRSSSDSFALFEGGSAAGGMYEFDNVLDGMRGGGQVASLAGAPEFFPEPASFGRPWESRQMYRQGGGMPMPGREKNGGRHGPSSSFGEHELGHVPNGVNRKAHGDAAYDQRIVIERKEGLRHSQSETDTKRAKQQYAQRSRVRKLQYIAELERRVQSLQTEGIEVTAEMDFLGQQNIMLDLENKALKQRLESLSQEHLIKRYQQEMFEREIGRLRTLFQQQQQQQHVPQQQAPTHSRSNSRDLDSQFANLSLKHSDPSSGRDAISGLRI

SEQ ID NO: 83 - DNA, 1419 bp, Arabidopsis thaliana
  misc_feature (1)..(1419): Ceres CDNA ID no. 23629711
  misc_feature (1)..(1419): Also Known As Ceres GEMINI ID no. 5110A11
atgggaggaggaggcatgtttgaagaaattgggtgttttgatccaaatgctccggcagaaatgactgctgagagcagtttctctccgtccgagccaccaccgacgatcacggtcatcggtagcaacagtaacagcaactgcagtctagaagatctctctgcattccacctcagcccacaagactcttctctacctgcctcagcctcagcttatgctcatcagcttcacattaatgctactcctaattgtgatcatcaattccagagttcaatgcaccaaaccctccaagatccatcgtatgcgcaacagtcgaatcattgggacaatggttaccaagattttgtgaatttgggtcctaatcataccactcctgacctactcagtctcttgcaattgccaagatcctcacttccacctttcgcaaaccctagcattcaagacattatcatgacaacatcttcctctgtcgccgcctatgacccgctcttccatctgaattttcctctgcagcctcctaatgggagtttcatgggagtggatcaagatcaaactgagactaaccaaggagtgaacttgatgtatgatgaagaaaacaacaacctcgacgatggtcttaaccgtaaaggcagaggatcgaaaaagcgtaaaattttccctacagaacgcgagagaagagttcacttcaaagaccggtttggtgacttaaagaatctaattccaaatcccaccaaggtttacacttacttaaatactaacttcttcttcaagtaagaaatcttcagaaactaattaaacccttttttcttatatctctagaatgatagagcatcaatcgtcggagaagcgatagattacatcaaagagttgctaaggacgatcgatgagttcaagctgctagtggaaaagaagagagtgaaacagaggaacagagaaggagatgatgttgttgatgagaacttcaaggctcaaagcgaagtagtagaacaatgtttgatcaataagaagaacaatgccttgagatgctcatggctcaagaggaaatcgaaattcactgatgtcgatgtacgtatcatagacgatgaagttaccatcaagatcgtgcagaagaagaaaatcaattgtttgttgttcgtatccaaagtcgttgaccaacttgagcttgatcttcaccatgtagctggtgcacaaatcggagagcaccacagtttcttgttcaacgccaaggtttgtcataaaatctcaatttaatccatagtcagacactattagactaactaacgaattgtgatataacagattagtgaaggatctagtgtttatgcaagtgccatagcagatagagtaatggaagtgttgaagaaacaatacatggaagctctttcggcgaataatggttatcactgttactctagtgattaa

SEQ ID NO: 84 - protein, 420 aa, Arabidopsis thaliana
  misc_feature (1)..(420): Ceres CDNA ID no. 23629711
  misc_feature (1)..(420): Also Known As Ceres GEMINI ID no. 5110A11
  misc_feature (213)..(262): Pfam Name: HLH Pfam Description: Helix-loop-helix DNA-binding domain
MGGGGMFEEIGCFDPNAPAEMTAESSFSPSEPPPTITVIGSNSNSNCSLEDLSAFHLSPQDSSLPASASAYAHQLHINATPNCDHQFQSSMHQTLQDPSYAQQSNHWDNGYQDFVNLGPNHTTPDLLSLLQLPRSSLPPFANPSIQDIIMTTSSSVAAYDPLFHLNFPLQPPNGSFMGVDQDQTETNQGVNLMYDEENNNLDDGLNRKGRGSKKRKIFPTERERRVHFKDRFGDLKNLIPNPTKNDRASIVGEAIDYIKELLRTIDEFKLLVEKKRVKQRNREGDDVVDENFKAQSEVVEQCLINKKNNALRCSWLKRKSKFTDVDVRIIDDEVTIKIVQKKKINCLLFVSKVVDQLELDLHHVAGAQIGEHHSFLFNAKISEGSSVYASAIADRVMEVLKKQYMEALSANNGYHCYSSD

SEQ ID NO: 85 - DNA, 3412 bp, Arabidopsis thaliana
  misc_feature (1)..(3412): Ceres CDNA ID no. 23651543
  misc_feature (1)..(3412): Also Known As Ceres GEMINI ID no. 5109B7
atggacgttctcgccttatcctcttccgcttccgccgccgcaccctccgcttctctcgccggaaaattcctgtcgtttccttctagggttagagtgagaagaaaccgagagaatttgttagctaaacagaagaagtttttagtttctgcttcgaaaagagaagagcctaagctcaacgaatgggatcaaatggagctcaactttggccgtttactcggcgaagacccgaaattgactttggctaaggtgagagatttcgtaaaaaacggttctttgaattttatgtatttcgatttctctctgttgtgctgatgatgttaatggtgaaatttatacagatagtagctagaaaagtggatccagaagcttcttttattgacattgagaaatctttctacaagaacaaaggtaaaattcctgaagttgaagagattccattggattggtcaaaggataacaagaagaaatctactagttcactggatggattgaaattggtaaagcctgttctgaaagatggagtcaagttcgaaaggccagtgatgaagaagccaagccctgttttgaagaagccattggtggaggctgttgctgctccaaaggtgcagagattgcctaatgttatattgagaaagccgagttcgttttatactagtaatggtgatgatgaggagtctaagttgcggttgaaaccgaatctgacattgaaaatgagaaatgagagggaaaatgagaggtttagtgatatgacattgttgagaaaaccggaaccagtgagcgtagttgcagaagaggaagacaagcctctttctgatgatttaactatggaggaaggagaacaggaaggtggaacatattcacagtatactcttttggagaagccagaagcgaggctccagcctgtcaatgtagaagaggaagttggagatagcggaggagtggaatcatctgagatagtaaacaactcaattcagaagccagaagcaaggccagagcttgagaacatagaaaaggaagttgcagatagcggagttttggaatcatcggagatagaaaataattcaattccaactggtatagagacaaactaagaatatttttaaatagtctaactttgtgctgattcatatgtttgttgttttatcaagaaatgcagctcaatagcgagatgtcctctgaggagaaaactattaacagtgatccactcgagagaattccttcgaaaccaatttctcaaaccatcgtcgaagcttctttacaagggaaaccacaaaggtgaattctggtttagtatcttgactttgaggaattttgctttcttgactcctattttctgttttgcctgactggttacttttattatagattagacccgtcttccgctgagccatcagttccgaacataggaaaaccgtcagtcgtgaaccatgaaggccgtcaggtctctgttgagctcaagggccctcctaccagatcgtccttggaggttgagaactaacactctcttactatttgttccttaataagataagaggcgtatgataaactcgttttgtgtgatttttataggaaaatgattggaataaggcagagtctctagttaaaacagaattacgagcagatgttgagctaataagttcaagcactagaggatttgctgtaagttagatctgtactcacttctggtttcatctcattttgttttactaattatttttttataccatttataatctttgttcaggtttcctatggatctttgattggatttttaccctaccggaaccttgcagcaaaatggaagtttctcgcatttgaatcatggttaagaagaaaaggtgtagatccatcaccgtatcgacaaaaccttggggtaattggaggtcaagatgtcacgagtaaatctccatctccagattcaagcttagattctgaagtcgctacaacgatcaacggagaagtttcttctgatatgaagctggaagatcttcttatggtatatgacagagagaagcagaagttcctgtcatcttttgttggtcaggtatgtctaaaaaacctatgactttaatttccatacatggaaatgcttgtttttcctttctaaacaatttaactcaatgcagaaaatcaaagtgaatgttgttatggcaaatcgaaattcaaggaagcttatattttcaatgaggccgagagaaaatgaagaggaagttgagaaaaaacgaactcttatggctaagcttcgtgttggggatgttgtgaaatgctgcatcaagaaaattacctattttggtattttctgtgaggtactaactactaacttacagaagttaaaatatctttgaaccttcttgctttattgactggcaagaacggaatctagaatgttgtgtaaaactaaaaagttgggttgaaacagctagaaggtgtccctgcattggttcaccagtcagaagtttcatgggatgcaactttagaccctgcttcatatttcaagattggtcaggtaatatctcgaactatcgtaaacactgctaaggaatacaactgtttgacaaacctttctttttgttgttatcagattgtggaagcgaaagtgcaccagctagattttgctcttgaacgtatcttcttgtcattaaaagaaattacggtgagaaagatctctcaaaagtttatcttgtagcaattggtaactcattttgatatatacctagacccgtttgatgtctttatgcagcctgatcctcttactgaagctttagaatctgtagttggtggtgataatgatcagttggggggacgattacaagcagcagagctcgacgctgaggtattaaagaccttctgtgattttatgtgatgaaaccattattacaggtttctgaaacctttcttctgcagtggcctgacgtggaatctctgatcaaagagctggaaatggttgaaggaatccaatcagtctcaaaaagtcgtttcttcttgagtccgggtcttgctccaacgtttcaggtacacagtttaatcacctaaaatgtatatatcaaaacacgaaaacatctaacagaccgctaaagagttgaatactgttgcggcttccttagcgaaaaaatgtgaacgttttatgttttgatcggaagctaagagctctggtttgctttctctctctttgtaggtttacatggctccaatgtttgagaaccaatacaaactgcttgctcgagctggaaacagagtacaagaggtaaaagaaagaaagagaaagatctaacttataacatctgttttattttaatcttggatgattcagtttttttcctttactgtttatctgcagcttattgttgaagcatccttgagcaaagaagagatgaaatctacaatcatgtcttgcaccaacagagtagaatga

SEQ ID NO: 86 - protein, 767 aa, Arabidopsis thaliana
  misc_feature (1)..(767): Ceres CDNA ID no. 23651543
  misc_feature (1)..(767): Also Known As Ceres GEMINI ID no. 5109B7
  misc_feature (578)..(650): Pfam Name: S1 Pfam Description: S1 RNA binding domain
MDVLALSSSASAAAPSASLAGKFLSFPSRVRVRRNRENLLAKQKKFLVSASKREEPKLNEWDQMELNFGRLLGEDPKLTLAKIVARKVDPEASFIDIEKSFYKNKGKIPEVEEIPLDWSKDNKKKSTSSLDGLKLVKPVLKDGVKFERPVMKKPSPVLKKPLVEAVAAPKVQRLPNVILRKPSSFYTSNGDDEESKLRLKPNLTLKMRNERENERFSDMTLLRKPEPVSVVAEEEDKPLSDDLTMEEGEQEGGTYSQYTLLEKPEARLQPVNVEEEVGDSGGVESSEIVNNSIQKPEARPELENIEKEVADSGVLESSEIENNSIPTEMQLNSEMSSEEKTINSDPLERIPSKPISQTIVEASLQGKPQRLDPSSAEPSVPNIGKPSVVNHEGRQVSVELKGPPTRSSLEENDWNKAESLVKTELRADVELISSSTRGFAVSYGSLIGFLPYRNLAAKWKFLAFESWLRRKGVDPSPYRQNLGVIGGQDVTSKSPSPDSSLDSEVATTINGEVSSDMKLEDLLMVYDREKQKFLSSFVGQKIKVNVVMANRNSRKLIFSMRPRENEEEVEKKRTLMAKLRVGDVVKCCIKKITYFGIFCELEGVPALVHQSEVSWDATLDPASYFKIGQIVEAKVHQLDFALERIFLSLKEITPDPLTEALESVVGGDNDQLGGRLQAAELDAEWPDVESLIKELEMVEGIQSVSKSRFFLSPGLAPTFQVYMAPMFENQYKLLARAGNRVQELIVEASLSKEEMKSTIMSCTNRVE

SEQ ID NO: 87 - DNA, 1808 bp, Arabidopsis thaliana
  misc_feature (1)..(1808): Ceres CDNA ID no. 23653450
  misc_feature (1)..(1808): Also Known As Ceres GEMINI ID no. 5109C6
atggcgggtttctcactgtactgttttaaaaaccctcgaattctctttactcttccgtcggaatcacctctctttgttttgggttctgataaatgttcaccggcgacgagacggccgagtagaaagactcgtgggtttgtcgtgacgtacgcgcactctaatccgaagataatcaatccgaagaagaagtcgaggtatgggcaaacgttatctccatatgacagtgatgaagatgatgatgatgatgatgatgatgatgatgatgactggttacttaatgttagtttcttttgttttctcttatgaaatttgtttgattttgagattaagggtttaaaagatttgtcttttctttaggatgatttcgctgaggttacagagtatgagaagaagaagcctaagtcacataagcaaaccattgctaagaaaagtttgtcttctcttgatttgaatctgcatctgcaatgaaatgattttgctaagatgtggctttgtttgtgaaggtgtgaagaaagggattgtcaagcctgaagaaagtgagactgatgaagatgatcttgatttaggcattagtcctaatgccacttctgagaagaagaaggagtcttggcgtttagatggtcgaggaaaggtaaaaagagttttgcttaaatacctcttctttgtcgttgagttgagaaagttactctttttcttgtgtgtttcgttagatgagttcgaggaagtatgtggagaaactataccctcggctcgcagaagagattgatatagatccgaaatgtgtaccacttctggattacttaagcacatttggtttgaaagagtcacactttgttcaaatgtacgagagacacatgccatcccttcagattaatgtgttctcagctcaagagagactcgattacttgttgagtgtcggtgttaaacacagagatatcaagagaatgctcttgagacaaccacagatacttcaatacactgttgagaacaatctcaaagctcacatttcctttctaatgggtcttggcattcctaattccaaaataggacagattgttgctgctaccccttctctcttctcttacagtgtagagaattcattgagacctacgataaggtatctgatcgaagaggttgggataaaggaaaccgatgttggaaaggttgtgcaacttagccctcagattctggttcagcggctcgacataacatggaacactcgctacatgttcctctccaaggagttaggagcacctagagacagcgtagtgaagatggtaaagaagcatccgcagcttcttcactacagtatcgatgacgggttcttgcctcgaatcaatttccttaggagcattgggatgtgcaattctgatatactgaaagtcttgactagccttacacaggttagtagattgcttgattctttttcatacttaaatcaaaactagaatgtttgttctcataaacacttgtcaaattggtctgaataggttttgtctctttcactagaagataatctaaaacctaagtacatgtatttggtcaatgagctcaataatgaagttcacattctgaccaaatacccaatgtacttgagcttgtccttggatcaaaggatacgtccgcgccaccgcttcttggttgagttaaagaaagtgcggaaagggccattccctcttagttcattagttccaaatgatgaaagcttttgtcagcaatgggctggaaccagtgtagatacgtatctcgcctttcgccagaggctgttactcaaggagtttgcaaacaagtatgacaagagaggatga

SEQ ID NO: 88 - protein, 496 aa, Arabidopsis thaliana
  misc_feature (1)..(496): Ceres CDNA ID no. 23653450
  misc_feature (1)..(496): Also Known As Ceres GEMINI ID no. 5109C6
  misc_feature (366)..(466): Pfam Name: mTERF Pfam Description: mTERF
MAGFSLYCFKNPRILFTLPSESPLFVLGSDKCSPATRRPSRKTRGFVVTYAHSNPKIINPKKKSRYGQTLSPYDSDEDDDDDDDDDDDDWLLNDDFAEVTEYEKKKPKSHKQTIAKKSVKKGIVKPEESETDEDDLDLGISPNATSEKKKESWRLDGRGKMSSRKYVEKLYPRLAEEIDIDPKCVPLLDYLSTFGLKESHFVQMYERHMPSLQINVFSAQERLDYLLSVGVKHRDIKRMLLRQPQILQYTVENNLKAHISFLMGLGIPNSKIGQIVAATPSLFSYSVENSLRPTIRYLIEEVGIKETDVGKVVQLSPQILVQRLDITWNTRYMFLSKELGAPRDSVVKMVKKHPQLLHYSIDDGFLPRINFLRSIGMCNSDILKVLTSLTQVLSLSLEDNLKPKYMYLVNELNNEVHILTKYPMYLSLSLDQRIRPRHRFLVELKKVRKGPFPLSSLVPNDESFCQQWAGTSVDTYLAFRQRLLLKEFANKYDKRG

SEQ ID NO: 89 - protein, 499 aa, Triticum aestivum
  misc_feature (1)..(499): Ceres CLONE ID no. 918824
  misc_feature (1)..(499): Functional Homolog of  Ceres CDNA ID no. 23653450 at SEQ ID NO. 88 with e-value of 3.20E-126 and percent identity of 55.5
MALLQLHPPPLAALGRSVLPCRPFPSATATARRSLASVAFSLQTNVRLLKPNRRSRRSRYPYYDLDDDEEEEDEEYDEDDESEDDLSGLEYLGVLYTNNPRAPNKRAGRKTQLVKENWEGRRPKTRDKHASPGRSNSLQPRSKINRTLLNLTSMNSEVELKNESISRILFEKLQEEYDFDDKWLPLIDYLCSFGLRESHFTYIYERHMACLQINRASAEERLEFLLSVGVKSKDLKRMLVRQPQILEYTLSNLKSHVAFLAGIGVPDARMGQIISSAPSFLSYSIEQSLKPTISYLIEEVGIEERDVGKVVQLSPQILVQRIDNAWKSRFLFLSKELGAPKDSIVKMVTKHPQLLHYSIEEGILPRINFLRSIGMRNSDILKILTSLTQVLSLSVEKNLKPKYLYLVNDLKNEAQSLTKYPMYLSLSLEQRIRPRHRFLVSLKKAPKGPFPLSSFVLTDERFCQRLAGTSLEKYHTFRQSLLLTGFEDKTGRKPLASRR

SEQ ID NO: 90 - protein, 503 aa, Oryza sativa subsp. japonica
  misc_feature (1)..(503): Public GI No. 50938747
  misc_feature (1)..(503): Functional Homolog of  Ceres CDNA ID no. 23653450 at SEQ ID NO. 88 with e-value of 0.0 and percent identity of 59.0
MAPPPPLAALRPAPFPLPRLLPCPASAAARRGAVAFSLQTNVRLLKPNRRSRRSRYPYYDHDEDEDDDEAEFEFEEGEEEEEDGYETDDDLSGLEYPGVLYSNNPRAPIKKPGREKPALKQNWEGRQPKTRDRCDTSKKVDALHAKSKASRSTGLVDIDNEVELKNESISRSLFQKLQEEYDFDDKWLPLIDYLCTFGLKESHFTNMYERHMACFQISQASAEERLEFLLSVGVKSKDMKRMLVRQPQILEYTLSNLKSHVAFLVGIGVPSARIGQIISAAPSFFSYSVEQSLKPTIRYLIEEVGIEESDVGKVVQLSPQILVQRIDSAWKSRFLFLSKELGAPKDNIVKMVTKHPQLLHYSIEDGILPRINFLRSIGMRDTDVLKVLTSLTQVLSLSLEENLKPKYLYLVNDLKNDVQSLTKYPMYLSLSLDQRIRPRHRFLVSLKKAPKGPFPLSSFVPTDERFCKRWAGTSLEKYHTFRQSMLLKGFSEKTGRKTLTSRR

SEQ ID NO: 91 - DNA, 1598 bp, Arabidopsis thaliana
  misc_feature (1)..(1598): Ceres CDNA ID no. 24374230
  misc_feature (1)..(1598): Also Known As Ceres GEMINI ID no. 5109G4
atggcggcgacgagcgagcacaccatcttgcaatttgtgtctccgtcatcaacggcgtccgctacaacctctgtactcacggcgaggatccaccctctcgttatctttaacgtctgtgattgcttcgtgagacgtcctgactcagctgaacgagtcatcggaactctcctcggatctatcttacctgacggaaccgtcgatatccgcaattcatacgccgtccctcacaatgaatcatccgatcaggttcgaaattttgatctctaaatttctcctctctctcgattctctatcgttggagatcctagatctttcgtagctgaagatttgcttgttaggatgtgaatgtttataggagtagtgttagcttcataccccaaggttgtgacttgtgataagttttgagggttatggtttgatatggatgcaggttgctgtggatattgattaccaccacaatatgttagcttcacaccttaaggtgaattcaaaggaaactattgtcggctggtacttctcgtttcccactcttattctcttatactctcatgattagtctcatatctttgtcacatgattcttgtagctgtgttggaacactgcattaggtagtttctcattttggaatagttgattgaacaagtttattgatttgcaggtattcaactggtgctggggttaatggcggtagttcgctgattcatgatttctatgctagagaagtacccaacccaattcacctaactgtggatactgggtttactaatggtgagggtactatcaaagcttttgtctcttcaaacctctcactcggtgatcgacaactcgttgcacattttcaagagattcctgttgatctccgcatggttgatgctgagagagtcggatgtgagtattctatccttttattagtaaccaattctatattcaaaatacataacagtcctcattcctcaattgtctaagtagttcagtttctgcatggttgattcagtatctagagattgtttccctaatgattgtgaatgaaccaacgggaatagatgatctttggttgtgtctgttcagtagattaatgattgtgactgatttaaaaacatcattttgatccacagtcgatgtacttaaggcaacatctgttgacaaactcccaaatgacttggaaggaatggagttaacaatggagaggctgttaactctaatcaacgatgtctacaaatatgttgacagtgtcgtggtaagcttatgatatccttgactgtctattatcgaccatagatacatgatctttgatacagagttttaatgaaatttcccagggaggtcaaatagctccagacaacaacattggacgattcattgcagatgcagtagcctcccttcccaagttacctccacaagtcttcgataacctcgtgaatgatagtctccaggtaaaagattgtaaatttcaagccaaagcaaaacactttgtaaaaaactaatggttgtttcttctgttatttcaggaccaattgcttctgttgtacctatcaagcataacaaggacacagttgagtctagcggagaagctaaacacagctgctcaaatgctataa

SEQ ID NO: 92 - protein, 293 aa, Arabidopsis thaliana
  misc_feature (1)..(293): Ceres CDNA ID no. 24374230
  misc_feature (1)..(293): Also Known As Ceres GEMINI ID no. 5109G4
  misc_feature (23)..(133): Pfam Name: Mov34 Pfam Description: Mov34/MPN/PAD-1 family
MAATSEHTILQFVSPSSTASATTSVLTARIHPLVIFNVCDCFVRRPDSAERVIGTLLGSILPDGTVDIRNSYAVPHNESSDQVAVDIDYHHNMLASHLKVNSKETIVGWYSTGAGVNGGSSLIHDFYAREVPNPIHLTVDTGFTNGEGTIKAFVSSNLSLGDRQLVAHFQEIPVDLRMVDAERVGFDVLKATSVDKLPNDLEGMELTMERLLTLINDVYKYVDSVVGGQIAPDNNIGRFIADAVASLPKLPPQVFDNLVNDSLQDQLLLLYLSSITRTQLSLAEKLNTAAQML

SEQ ID NO: 93 - protein, 289 aa, Glycine max
  misc_feature (1)..(289): Ceres CLONE ID no. 1507510
  misc_feature (1)..(289): Functional Homolog of  Ceres CDNA ID no. 24374230 at SEQ ID NO. 92 with e-value of 0.0 and percent identity of 91.3
MAAANEHTVLQFATPSSTTSILTARIHPLVIFNVCDCFVRRPDSAERVIGTLLGSILPDGTVDIRNSYAVPHNESSDQVAVDIDYHHNMLASHLKVNPKEIIVGWYSTGLGVNGGSALIHDFYAREATNPIHLTVDTGFTNGEGAIKAFVSSNLSLGDRQLAAQFQEVPVDLRMVEAERVGYDVLKATAVDKLPNDMEGMELTLERLLTLINDVYKYVDSVVEGQRLPDNNIGRFIAEAVASLPKLPPQVFDNLVNDSLQDQLLLLYLSSITRTQLSLAEKLNTAAQML

SEQ ID NO: 94 - protein, 287 aa, Zea mays
  misc_feature (1)..(287): Ceres CLONE ID no. 500887
  misc_feature (1)..(287): Functional Homolog of  Ceres CDNA ID no. 24374230 at SEQ ID NO. 92 with e-value of 3.90E-105 and percent identity of 70.1
MATPPALLFPSPSSASSPPSSAQVEAVVLFNVCDSYVRRPDQADRVIGTLLGSLLPDGTVHVRNSYVVPHSESADQVAIDIDYHHNMYASHQKVNPKEVIVGWFSTGFGVSGGSTLIHEFYSREVQSPIHLTVDTGFTRGEASIKAYVSSNLSLGDRQLAAQFQEIPLDLRMIGAEKAGFEILKSTMVEKLPNDLEGMESSMEKLYILIDEIYKYVDDVVEGRVAPDNRIGRLVSESVASMPKLSPAAFDKLFNDKIQDNLALVYLSSITRTQISIAEKLNTAAQAL

SEQ ID NO: 95 - protein, 284 aa, Oryza sativa subsp. japonica
  misc_feature (1)..(284): Public GI No. 50931081
  misc_feature (1)..(284): Functional Homolog of  Ceres CDNA ID no. 24374230 at SEQ ID NO. 92 with e-value of 9.10E-106 and percent identity of 71.0
MAAAEGPVLLFPSTSSTSARVEAVVVFNICDSYVRRPDQAERVIGTLLGSVLPDGTVHVRNSYVVPHNESPDQVALDIEYHHNMYASHHKVNPKEVIVGWFSTGFGVSGGSTLIHDFYSREVQSPIHLTVDTGFTRGDASIKAYISSNLSLGDRHLAAQFQEIPLDLRMLEAGKVGFDILKSTIVEKLPNDLEGMESSMEKLYVLIDEIYKYVDDVVEGRVAPDNKIGRFISDAVASMPKLSPAAFDKLFNDRIQDNLALVYLSSITRTQISIAEKLNTAAQIL

SEQ ID NO: 96 - DNA, 2404 bp, Arabidopsis thaliana
  misc_feature (1)..(2404): Ceres CDNA ID no. 2999012
  misc_feature (1)..(2404): Also Known As Ceres GEMINI ID no. 5110B6
atgagttgttcttatctactttctggtgacgcttccgtcgtcgcttcacggcggtggagtgatgtttcttcccggcagcgtttatttctcccacggcaatcactccggcagccatcgggttcttcgttttcccgatgcgtccgattagtcgctaatgtaaatgatcatttcagtaaacaatcactcgcgacgagaaattgcttggcttcagtgtttagtgcagacttgggtggaagtaacggtaataatgataacggaaatggcggcggtggcggaggagacggcggcggcgataactctgatgattcttctttcgatttgagatacctctgctttcttttattgggcttgtcttgcttcttccatttccgattatcagctgcgtccgccatagctaaagatcaaaattcggatagtaatggagatgctgtgaaagagacggtttgggaagtgagaggaagtaaaaggaagagactagttcccgattttgtcaaagatgagttcgtctctgaagaatctgcttttgaattatcatcttctctaactcctgagaatctcctagctcaatgtagaaaccttctcactcaattccttcttcctgaaggttttcccaatagtgtaacttctgattacctcgattactctctctggagaggtgttcaaggtattgctagtcaaatcagcggcgttcttgccactcaggtagacgactgagcttatcatctctcttaggcattttcacaaacacttggtgttcattatattgtgttggtagtctttgctttatgcagttgggttaggtaaaggagcaattcctacagctgcagctatcaattgggtgcttaaagatggaattgggtatcttagtaagataatgttgtcgaaatacggacgacatttcgatgttcatcccaaaggatggaggctatttgctgatcttcttgaaaacgctgcttttggtatggagatgcttacgccagtcttccctcagtttttcgttatgatcggtgctgctgctggtgctggtcgatctgctgctgcattgattcaggttctgttcttgtctctgaaagctctatttgcatagctctaagtgcagcatttgttatagtttagtattttctattgaacttatcatttacttgtctgcaggctgctactagaagttgcttcaatgctggctttgcttctcaaaggaactttgctgaggtctacaataatttttatatggccttagtcttgatcacttatcaacagctatttgtttttctcaactattctgggtctctagtgtatgcatcaacaacttcttttgtaggtaattgccaagggtgaagctcaaggaatggtgagcaagtcagtgggtattctgctaggaatagtggttgccaattgcataggaacctctacaagtcttgcccttgctgcatttggagttgtgactacaatccatatgtataccaatctcaaatcttaccagtgtatccagctccggactctaaacccataccgtgcaagtaaatcccactcctgcagacgtccaattcattcaaatcgtcttacaagacgaaaataacatctctgtttattttgcaggtttggtttttagtgaatatctaatcagcggccaagctcctctaatcaaggaggtcaacgatgaagaaccgctcttcccaacagttcggttttcaaacatgaaatctccagaaaaggtaaaagtgttcattcaccttattatacactctgagatctcttatcaactagtttaaaatctaaaaactttctcggatgaacaaaacaatacttgatgacctgattgattgattcttagtatctgctctattcagctgcaagattttgtcttatcatcagaagcaaaagcagcagccgcagacatagaggaacggcttcaactagggtcaaagctcagcgatgttatccacaacaaggaagaagcaatagcactgtttgatctatatcgcaatgaaggctacatccttacagaacacaaaggaagattctgcgtaagcaatgataaaccttctcataattattattacccagcggaatctctcaccattctatctcctcttgtaattgtcaggtgatgctcaaggaaagctcaactccacaagacatgctcaggtcattgtttcaagtgaactacctctactggctagagaagaatgctgggatcgaacccgcaagcacttactcagactgcaaacccggtggtcgccttcacatttctttagattatgtgcgacgagagtttgaacacgccaaagaagacagcgaatcagtaggttgggtcactgaaggactgatagctagacctctaccaaccagaatccgtctaggtcatgatcgtgaactattattatcttctccaaacagctcataa

SEQ ID NO: 97 - protein, 631 aa, Arabidopsis thaliana
  misc_feature (1)..(631): Ceres CDNA ID no. 2999012
  misc_feature (1)..(631): Also Known As Ceres GEMINI ID no. 5110B6
  misc_feature (177)..(616): Pfam Name: DUF647 Pfam Description: Protein of unknown function, DUF647
MSCSYLLSGDASVVASRRWSDVSSRQRLFLPRQSLRQPSGSSFSRCVRLVANVNDHFSKQSLATRNCLASVFSADLGGSNGNNDNGNGGGGGGDGGGDNSDDSSFDLRYLCFLLLGLSCFFHFRLSAASAIAKDQNSDSNGDAVKETVWEVRGSKRKRLVPDFVKDEFVSEESAFELSSSLTPENLLAQCRNLLTQFLLPEGFPNSVTSDYLDYSLWRGVQGIASQISGVLATQSLLYAVGLGKGAIPTAAAINWVLKDGIGYLSKIMLSKYGRHFDVHPKGWRLFADLLENAAFGMEMLTPVFPQFFVMIGAAAGAGRSAAALIQAATRSCFNAGFASQRNFAEVYNNFYMALVLITYQQLFVFLNYSGSLGEAQGMVSKSVGILLGIVVANCIGTSTSLALAAFGVVTTIHMYTNLKSYQCIQLRTLNPYRASLVFSEYLISGQAPLIKEVNDEEPLFPTVRFSNMKSPEKLQDFVLSSEAKAAAADIEERLQLGSKLSDVIHNKEEAIALFDLYRNEGYILTEHKGRFCVMLKESSTPQDMLRSLFQVNYLYWLEKNAGIEPASTYSDCKPGGRLHISLDYVRREFEHAKEDSESVGWVTEGLIARPLPTRIRLGHDRELLLSSPNSS

SEQ ID NO: 98 - DNA, 996 bp, Arabidopsis thaliana
  misc_feature (1)..(996): Ceres CDNA ID no. 4950532
  misc_feature (1)..(996): Also Known As Ceres GEMINI ID no. 5110F2
atgcaacggaggagcaatgagatagaggaggaggaggaacaagaagatggaaggagaagactggagagcgtgagagagagccagttggaagggagaagcagcggaacagtgtccatgaacggagaggacaacgtctatgttggggttgggaaaggagactcaagtatggaggcattgcgttgggctattgacaacctaatgacttcttcttctactcttcttttcctcatccatgtcttccctgagactcgcttcattccttacccctgtctgtatatatcctctcgtccatttgttaactttgattaaatgtgcgtccgcactcaagtgtatgtatgattcgtgtagtggggaggataacgagggagagagcaagtcaagaacaagtagaaagctttatgtctcaggaaagggaaaagagaagaactctgttgctcaagttccttcatgcctgctctgcttctaaggtcccatctctctctctttctctcttttggtgttgtttggatggttaagagtggatcaagatagttagctaacatatgagaaagtgaggaacaggtgaaggtggagacaatactggttgagagtgactcggtcgctaaggctgtacaagacctcattaccattcttaacattaggaagcttgttcttgggatcgacaagtctaatgctaggtatatatatatacacaaagatgaaccacacaactttttcagttgtcagatgacaagacaccgttctctctttatggctttttgtaggaaagcatccacaatgaaaggaaacagtgtccctgaactgataatgaggagctccgcagcagacgtgtgtgaggttaaagtcatatgccaagggaaagagataaatatggagcagacgatgatggagagcagcccagctaagtccccaatagtgcagcggcaaaagaaagatcaacctgttgacccttttgcttgcatttgctttatcagtaagcccaaaactaacagataa

SEQ ID NO: 99 - protein, 174 aa, Arabidopsis thaliana
  misc_feature (1)..(174): Ceres CDNA ID no. 4950532
  misc_feature (1)..(174): Also Known As Ceres GEMINI ID no. 5110F2
MQRRSNEIEEEEEQEDGRRRLESVRESQLEGRSSGTVSMNGEDNVYVGVGKGDSKSEEQVKVETILVESDSVAKAVQDLITILNIRKLVLGIDKSNARKASTMKGNSVPELIMRSSAADVCEVKVICQGKEINMEQTMMESSPAKSPIVQRQKKDQPVDPFACICFISKPKTNR

SEQ ID NO: 100 - protein, 244 aa, Arabidopsis thaliana
  misc_feature (1)..(244): Public GI No. 28394029
  misc_feature (1)..(244): Functional Homolog of  Ceres CDNA ID no. 4950532 at SEQ ID NO. 99 with e-value of 1.79E-68 and percent identity of 98.8
MQRRSNEIEEEEEQEDGRRRLESVRESQLEGRSSGTVSMNGEDNVYVGVGKGDSSMEALRWAIDNLMTSSSTLLFLIHVFPETRFIPYPLGRITRERASQEQVESFMSQEREKRRTLLLKFLHACSASKVKVETILVESDSVAKAVQDLITILNIRKLVLGIDKSNARKASTMKGNSVPELIMRSSAADVCEVKVICQGKEINMEQTMMESSPAKSPIVQRQKKDQPVDPFACICFISKPKTNR

SEQ ID NO: 101 - protein, 287 aa, Glycine max
  misc_feature (1)..(287): Ceres CLONE ID no. 525385
  misc_feature (1)..(287): Functional Homolog of  Ceres CDNA ID no. 4950532 at SEQ ID NO. 99 with e-value of 3.90E-18 and percent identity of 44.7
MEHDECISCGGFIGFKRNQVIDCSSEIGDSDTEELFEINLKEKEPLALDAIREDCEISTVFSLDIDIHDGGSGNDDDVVYVAVGKDGDSSMEALSWALKHAVTPSATVCIVHVFPQVKLIPSPLGKIPRSHVNLEYVNMHLTQEKGKRKLLLQKFTDLCVDSKVKVEMKLIEGDNVAKTIVDLVGNLNIRKLVIGITKSNLRKSGSRSHNSIAAKVLKNAQESCDIKIICEGREVIDQMSDCTSPRSIDVKGSLRLSQEKNESRGFVPLKHFMPSSLWLFRSITKMR

SEQ ID NO: 102 - protein, 172 aa, Oryza sativa subsp. japonica
  misc_feature (1)..(172): Public GI No. 55296678
  misc_feature (1)..(172): Functional Homolog of  Ceres CDNA ID no. 4950532 at SEQ ID NO. 99 with e-value of 2.40E-11 and percent identity of 35.4
MPKSQASPEQVETYMNQERSKRRVMLQKYLDHCRNFQVNVDVYLIESDHVTNAILELIPVFHVQQLVLGVSKSKLRKFKRGNTIAGQVQKNAPLYCEVKIVCDGKEVTTVPTADPTPPISPSPVNNKSNSISPTPLSPAPDHNNRAVADDDKKETNPNERNKITKYLKCFSF

SEQ ID NO: 103 - DNA, 1017 bp, Arabidopsis thaliana
  misc_feature (1)..(1017): Ceres CLONE ID no. 100085
  misc_feature (1)..(1017): Also Known As Ceres GEMINI ID no. 539F6
actactgttatttagcctgcaaagcccacaaacaaagggctacacaagtcttccttctctctctccctctccctctctttagatggaataatggatcaatgcttgtaaaggtttgaaatttgatcaagttttgaagaagcaaattgaaaaagaaaagaaaagagaagacatggaggtggagaagaggattgtagtgaatggaggaatgaaattgccaataggatacagatttcacccaaccgagcaagagcttatccttcattacttgctcccaaaggcctttgcttctcctttgccttcctccatcatccctgtctttgacctcttcttctctcatcctcttactttcccaggggaccaaaaggagaagcagaggtacttcttttgcaagaagagagaagtgtcaagtaatgagcatagaatcaagatttcctctggtgatggttattggaaacctattggtaaagagagaccaatcattgcctgtggtaaaacatttgggattagaagaacacttgctttctatgaaacaaacaagtcttcttcttattgcaacaaaactagatggagcatgacagagtattgtcttgcgggatttgcgtcggctaaggtgtctggagaatgggcagtgtacaatgtttatgagaggaaaggctcaaaaggaagaaaacagaggaaatcaagagagggagatgatgaagaattgagatgcatcgaccattttacggttgggtcaaatcatgaaaccggtccaccaccgccttctcctcctacctcagctgatgagtaatatatatatctcataggagacgttgagattgtgacaagctcctaaaccctaacctactattccacttacgtttctgtcaagctatttaaaaaatttcaacgtcttgatttatttgttagcgaaataagtaaagtaacatggttctaggggagctcattttgatctgaaactgttgaattgtatgagttgagatttgcacttttgttgggcaaaaccaaatatatgtc

SEQ ID NO: 104 - protein, 206 aa, Arabidopsis thaliana
  misc_feature (1)..(206): Ceres CLONE ID no. 100085
  misc_feature (1)..(206): Also Known As Ceres GEMINI ID no. 539F6
  misc_feature (15)..(141): Pfam Name: NAM Pfam Description: No apical meristem (NAM) protein
MEVEKRIVVNGGMKLPIGYRFHPTEQELILHYLLPKAFASPLPSSIIPVFDLFFSHPLTFPGDQKEKQRYFFCKKREVSSNEHRIKISSGDGYWKPIGKERPIIACGKTFGIRRTLAFYETNKSSSYCNKTRWSMTEYCLAGFASAKVSGEWAVYNVYERKGSKGRKQRKSREGDDEELRCIDHFTVGSNHETGPPPPSPPTSADE

SEQ ID NO: 105 - DNA, 935 bp, Arabidopsis thaliana
  misc_feature (1)..(935): Ceres CLONE ID no. 103581
  misc_feature (1)..(935): Also Known As Ceres CDNA ID no. 23462890
  misc_feature (1)..(935): Also Known As Ceres GEMINI ID no. 532G12
ctctttcgctttctctcttctctcccattaccctctctctcgttttctcatactctcaactaaatatgccgtcggaaccaaaccaaacccgacccaccagagttcagccctcaacggcggcttacccaccgccaaatctggctgagccacttccttgtcctcgctgcaactccaccaccaccaagttctgttactacaacaactacaacctcgctcagcctcgttactactgcaaatcttgccgccgttactggactcaaggtggtacactccgtgacgtccccgtcggtggtggaactcgtcgtagctcctcaaaacgtcaccgctctttctccaccaccgtaacttcctcttcctcatcttcttccgtcatcacctccacgacacaagaaccagccacgactgaagcgagtcagattaaggttagtaatgtaacttcaggtcatggaagctttgcttctctgttgggtttaggaagtggaaatggtgggctggattacgggtttgggtacgggtacgggcttgaggatatgagtattgggtatcttggagattcttccgtaggagagattccggtggttgatggttgtggttgacacgtggcagattggggagattgaaggtaaaagtggaggagacagtttgatatggcctggtcttgagatctcaatgcaaaccaacgatgttaagtgaaaatgaaaccgtttctgatttcttgcctttgtcttcttttgttggtgtctttttggaaatttctgtttgttttcttttttgtcctagaaagaagagcaaaagaaaccaaattgaagcaagaatgtttttatttattttagtttttgaggtccaacaattctggtgtataaatcctctgtttatgtgacgaacatattggaatggatttatgagtaaaaatgtaaaaacatttctttcttttc

SEQ ID NO: 106 - protein, 176 aa, Arabidopsis thaliana
  misc_feature (1)..(176): Ceres CLONE ID no. 103581
  misc_feature (1)..(176): Also Known As Ceres CDNA ID no. 23462890
  misc_feature (1)..(176): Also Known As Ceres GEMINI ID no. 532G12
  misc_feature (24)..(86): Pfam Name: zf-Dof Pfam Description: Dof domain, zinc finger
MPSEPNQTRPTRVQPSTAAYPPPNLAEPLPCPRCNSTTTKFCYYNNYNLAQPRYYCKSCRRYWTQGGTLRDVPVGGGTRRSSSKRHRSFSTTVTSSSSSSSVITSTTQEPATTEASQIKVSNVTSGHGSFASLLGLGSGNGGLDYGFGYGYGLEDMSIGYLGDSSVGEIPVVDGCG

SEQ ID NO: 107 - DNA, 655 bp, Arabidopsis thaliana
  misc_feature (1)..(655): Ceres CLONE ID no. 10375
  misc_feature (1)..(655): Also Known As Ceres CDNA ID no. 23388050
  misc_feature (1)..(655): Also Known As Ceres GEMINI ID no. 532H1
aatggttacttttacttcctcttcttctcttcttgttccatctttcatgtgaaagagagagttgaattttgcagatgagtatgagaagaagcaaagcggaagggaagaggagcttacgagaactgagtgaggaagaggaagaagaagaagaaactgaagatgaagatacttttgaagaagaagaggctttggagaagaagcagaaaggtaaagctacaagtagtagtggagtttgtcaggtcgagagttgtaccgcggatataagcaaagccaaacagtaccacaaacgacacaaagtctgccagtttcatgccaaagctcctcatgttcggatctctggtcttcaccaacgtttctgccaacaatgcagcaggtttcacgcgctcagtgagtttgatgaagccaagcggagttgcaggagacgcttagctggacacaacgagagaaggcggaaaagcacaactgactaaagacggtgaaacgtgtgagatcccggtttgaaggttaatgaaacagggctttggcttactctcttctgtcagtctcttttagctccttgtaatcctctgtgtctctgtctgttccccatattacctgtaatcaaagctatctgctaaacctacgacatggttaaataaatgcattgagacttagc

SEQ ID NO: 108 - protein, 131 aa, Arabidopsis thaliana
  misc_feature (1)..(131): Ceres CLONE ID no. 10375
  misc_feature (1)..(131): Also Known As Ceres CDNA ID no. 23388050
  misc_feature (1)..(131): Also Known As Ceres GEMINI ID no. 532H1
  misc_feature (53)..(131): Pfam Name: SBP Pfam Description: SBP domain
MSMRRSKAEGKRSLRELSEEEEEEEETEDEDTFEEEEALEKKQKGKATSSSGVCQVESCTADISKAKQYHKRHKVCQFHAKAPHVRISGLHQRFCQQCSRFHALSEFDEAKRSCRRRLAGHNERRRKSTTD

SEQ ID NO: 109 - protein, 134 aa, Betula pendula
  misc_feature (1)..(134): Public GI No. 30577630
  misc_feature (1)..(134): Functional Homolog of  Ceres CLONE ID no. 10375 at SEQ ID NO. 108 with e-value of 5.39E-37 and percent identity of 59.8
MEASRAEGKRSFMEEEEDQEEEEEEEEKREMSTSSSRRASGSGGSTPPTCQVENCNADLTDAKHYHRRHKVCESHAKAPIVYVAGGQKRFCQQCSRFHDLSEFDEYKKSCRKRLAGHNERRRKSSSDFHREGSN

SEQ ID NO: 110 - protein, 138 aa, Glycine max
  misc_feature (1)..(138): Ceres CLONE ID no. 538817
  misc_feature (1)..(138): Functional Homolog of  Ceres CLONE ID no. 10375 at SEQ ID NO. 108 with e-value of 7.10E-35 and percent identity of 60.4
MDGSWSEGKRSMSYKEEDEYEEEEEEEVSEYGDDGKKKRVVSNKRGSKAGGSVPPSCQVDGCNADLSEAKPYHRRHKVCEYHAKAPAVVIGDQHQRFCQQCSRFHELSEFDDSKRSCRRRLAGHNERRRKNASEYHGL

SEQ ID NO: 111 - protein, 131 aa, Antirrhinum majus
  misc_feature (1)..(131): Public GI No. 1183866
  misc_feature (1)..(131): Functional Homolog of  Ceres CLONE ID no. 10375 at SEQ ID NO. 108 with e-value of 6.20E-36 and percent identity of 62.5
MDTSKGEGKRVIKLPGSQEQGEEEDDIGEDSKKTRALTPSGKRASGSTQRSCQVENCAAEMTNAKPYHRRHKVCEFHAKAPVVLHSGLQQRFCQQCSRFHELSEFDEAKRSCRRRLAGHNERRRKSSHDTH

SEQ ID NO: 112 - DNA, 1212 bp, Arabidopsis thaliana
  misc_feature (1)..(1212): Ceres CLONE ID no. 106078
  misc_feature (1)..(1212): Also Known As Ceres CDNA ID no. 23372465
  misc_feature (1)..(1212): Also Known As Ceres GEMINI ID no. 555H6
attaaaccaaaaaaaaaactaactttttgggactccagaactaataatggatcccataaaacacatctctttaccagttcttgtcttgtttctactattatccgtgtcggcgggtcaacccggaaccccggaccagagacatgacccgtatgcttacagcggcagtctaagtccagccatggctgttgtcgttgtagttgtcatcgcagctctcttcttcatgggcttcttcaccgtctatatacgtcactgtactggcgcagtagacggtagcgttactcctgcaggaggagctaggaggagagtgacgaacgcaacggttgcgcgtgggttagacgtggagacgatcgagacgtttccgacttttgtttactcagaagtgaagacacagaagattggtaaaggagcgttggagtgtgcgatttgtttgaatgagtttgaagacgatgaaacgctgcgtctgttgcctaaatgtgatcacgtgtttcatcctcattgtatcggcgcgtggcttcaaggtcacgtgacttgtccggtttgtcggactaatcttgctgaacagacgcctgaaccggaagttgtggtggaaaccgatcttgaggcgcagcagcaatcggcggttcctgtaccggtggtggaacttccacgtgttaaattcccgaggtcgcatacgacggggcattcggtggttttaccgggagagagtaccgaccggtttacgcttagagtaccggaagaattaaggaagaagataatggcgaattggaaattgaaccggtcgaatagtgtttttgttttaccgagaggaggaagctcgaggagtggtaaacaggttgaccggtcgagggctaaatcggaccggtggttgttccgtaaaactccgtcgtttctatggaggaaccgggatgatggttcgattaggctaggtggtaccggtagtgttagaggaaattcagtaacaagtccgagcggtgactcggtacgagcagaccggtgggcttttcttagaaacccatcgtttctctggaggaatacgacgccggttccttcgccgagagttgaagtcaataataaggacggtgaaggaacatcgtcagttcaacatatcggtacagttggttcaactagcggttcccttaggctaccggtttagtgttcggtgatgttttgtgcattgttcataaacacgcaatagattttacgtaattcttt

SEQ ID NO: 113 - protein, 368 aa, Arabidopsis thaliana
  misc_feature (1)..(368): Ceres CLONE ID no. 106078
  misc_feature (1)..(368): Also Known As Ceres CDNA ID no. 23372465
  misc_feature (1)..(368): Also Known As Ceres GEMINI ID no. 555H6
  misc_feature (124)..(165): Pfam Name: zf-C3HC4 Pfam Description: Zinc finger, C3HC4 type (RING finger)
MDPIKHISLPVLVLFLLLSVSAGQPGTPDQRHDPYAYSGSLSPAMAVVVVVVIAALFFMGFFTVYIRHCTGAVDGSVTPAGGARRRVTNATVARGLDVETIETFPTFVYSEVKTQKIGKGALECAICLNEFEDDETLRLLPKCDHVFHPHCIGAWLQGHVTCPVCRTNLAEQTPEPEVVVETDLEAQQQSAVPVPVVELPRVKFPRSHTTGHSVVLPGESTDRFTLRVPEELRKKIMANWKLNRSNSVFVLPRGGSSRSGKQVDRSRAKSDRWLFRKTPSFLWRNRDDGSIRLGGTGSVRGNSVTSPSGDSVRADRWAFLRNPSFLWRNTTPVPSPRVEVNNKDGEGTSSVQHIGTVGSTSGSLRLPV

SEQ ID NO: 114 - DNA, 1104 bp, Arabidopsis thaliana
  misc_feature (1)..(1104): Ceres CLONE ID no. 108509
  misc_feature (1)..(1104): Also Known As Ceres CDNA ID no. 23365210
  misc_feature (1)..(1104): Also Known As Ceres GEMINI ID no. 539G6
cttctcgctctgtgacagattctcgctctctctacaaactgtcaggttgattgatgtagaggaatggatattagccggcgtgaaagtaagacggaagcaagtagtagagagaaacggatttatgagaaagatcagatgaatcaagagtcttttattgagggattggcagaggagtttcggttgccaattactcatagggttactgaaaatgttgatttggaggatgtggagcaagcttcgttagatgtaaagatatcgtcgtcgaatgtcgggtttcgtcttcttcagaaaatgggttggaaaggaaaaggtcttggaaagcaagagcaaggtataacggagcctataaagtccggtataagagatcgaagactcggtttagggaaacaagaagaagatgattatttcactgcagaggaaaacatccagcggaagaaacttgatatcgagattgaggagactgaggaaatcgcaaagaaacgggaggtcctagcagaacgtgagcagaagatccagagcgatgttaaagaaatccgtaaagtcttctattgtgaactatgcagcaaacagtatagaacggtgatgaagtttgaaggtcacttgagctcatacgatcacaaccataagaagcgattcaaagaaatgaaagaaatgcacggagcaagcggccgcgatgacaggaagaaacgagagcagcaacgtcaagagagggagatgactaaaatggctgatgctcgcaaacaacatcagatgcaacagagccagcaagaagtcccagagaatgtcccggtttctgcaccggctaagaccacggttgcaccacttgctgtccaagatcagcgaaaaacattgaagtttggcttctcttctaaaagcggcattatatcaaagagccaacccacaagcagcatcaagaagccgaaagtagcaatcgcgtccgttttcgggaacgatagcgacgaagattaactttgctacattatatgatcagaaacattgattgtactttatgtaattctacgctatggttcctttcacagattttaaaacagaatataaaaaattaacatttgtcttcaattttattcatatgtttgtttgttc

SEQ ID NO: 115 - protein, 301 aa, Arabidopsis thaliana
  misc_feature (1)..(301): Ceres CLONE ID no. 108509
  misc_feature (1)..(301): Also Known As Ceres CDNA ID no. 23365210
  misc_feature (1)..(301): Also Known As Ceres GEMINI ID no. 539G6
  misc_feature (66)..(109): Pfam Name: G-patch Pfam Description: G-patch domain
MDISRRESKTEASSREKRIYEKDQMNQESFIEGLAEEFRLPITHRVTENVDLEDVEQASLDVKISSSNVGFRLLQKMGWKGKGLGKQEQGITEPIKSGIRDRRLGLGKQEEDDYFTAEENIQRKKLDIEIEETEEIAKKREVLAEREQKIQSDVKEIRKVFYCELCSKQYRTVMKFEGHLSSYDHNHKKRFKEMKEMHGASGRDDRKKREQQRQEREMTKMADARKQHQMQQSQQEVPENVPVSAPAKTTVAPLAVQDQRKTLKFGFSSKSGIISKSQPTSSIKKPKVAIASVFGNDSDED

SEQ ID NO: 116 - protein, 306 aa, Triticum aestivum
  misc_feature (1)..(306): Ceres CLONE ID no. 764678
  misc_feature (1)..(306): Functional Homolog of  Ceres CLONE ID no. 108509 at SEQ ID NO. 115 with e-value of 3.80E-84 and percent identity of 65.6
MERPGHGGIGSGGGSKNPPPSGKDEYGGGYDRLDEEVEFRLPRGHRPVENLDTEGLEQASVDTRLASSNVGFRLLQKMGWKSGKGLGKNEQGILEPIKAGIRDAKLGVGKQEEDDFFTAEDNVQRKRLNVELEETEEHIKKREVTAEREQKIRSEVKEIQKTFFCSLCNKQYKLAYEFESHLSSYDHNHRKRFKEMKEMQSGGSGNRDDRQKREQQREEKELAKFAQLADAHRKQQKEKQEQPDISGEQATSKNLPTPGNQDQRRTLKFGFSKMTPSKAPVGSMSKKPKIATKVPSVFGNDSDEEA

SEQ ID NO: 117 - protein, 297 aa, Zea mays
  misc_feature (1)..(297): Ceres CLONE ID no. 333416
  misc_feature (1)..(297): Also Known As Ceres CDNA ID no. 23767681
  misc_feature (1)..(297): Also Known As Ceres GEMINI ID no. 538H6
  misc_feature (1)..(297): Functional Homolog of  Ceres CLONE ID no. 108509 at SEQ ID NO. 115 with e-value of 1.19E-82 and percent identity of 63.3
MESKQWGKTPQEVVGAGGGRQVDLDEEDDLEEFRLPMGHRPTENLDTEGLQQASVYTQLTASNVGFRLLQKMGWKTGKGLGKNEQGILEPIRADMRDAKLGVGKQEEDDFFTSEENVQRKKLNIELEETEEHIKKREVIAEREHKIRSEVKEIQKVFFCNLCNKQYKLAHEFESHLSSYDHNHRKRFKEMREMQSSSGSRDDRQKREQQREEKELAKIAQLADAHRKQQKDKQEKSETEDAAPKNMAASSNQDQRQTLKFGFSKMAPSKVLVGSASKKPKVATKVSSVFGNESDEDS

SEQ ID NO: 118 - DNA, 703 bp, Arabidopsis thaliana
  misc_feature (1)..(703): Ceres CLONE ID no. 11130
  misc_feature (1)..(703): Also Known As Ceres CDNA ID no. 23364997
  misc_feature (1)..(703): Also Known As Ceres GEMINI ID no. 532C11
atagaagaacaacaacaacaacaacaacaacacacgaagaagaagaagagaagcttatggcaggaggaggaacagaagcgtttcctgatcttggagagcattgccaagaccctgattgcaaattactcgattttctcccttttacatgcgacggctgcaaattggtgttttgtttggagcatagatcatacaagtcacataactgtccgaaatctgatcacgggagcagaacagtttccatctgtgaaacatgttctatagcgattgaaacaactggttttgatgaaagaggaatcaaatctttgcttgagaaacacgaaagatccggagattgtgatccaaacaagaaaaagaaaccaacgtgtcctgtaaaacgttgcaaagagattctgacttttgcgaataaccttacttgcaaagattgtggagtcaagttctgtttgaaacaccggtttccgacagatcatgtttgtaacaagaagaccattaataccgcgggaacaagatcgaggtggaacgagaggtttatggaagctttgagtttaagaaaccagaaaggatgtggaagaggaagctctgtttcatcaaaatctccagcatcagttagatcgttttagtttcttctcttgtgacaatactttgcatcaaccaattccttctttacgttctcatgtattttccattgtttgcaagaaagaagatt

SEQ ID NO: 119 - protein, 186 aa, Arabidopsis thaliana
  misc_feature (1)..(186): Ceres CLONE ID no. 11130
  misc_feature (1)..(186): Also Known As Ceres CDNA ID no. 23364997
  misc_feature (1)..(186): Also Known As Ceres GEMINI ID no. 532C11
  misc_feature (21)..(58): Pfam Name: zf-AN1 Pfam Description: AN1-like Zinc finger
MAGGGTEAFPDLGEHCQDPDCKLLDFLPFTCDGCKLVFCLEHRSYKSHNCPKSDHGSRTVSICETCSIAIETTGFDERGIKSLLEKHERSGDCDPNKKKKPTCPVKRCKEILTFANNLTCKDCGVKFCLKHRFPTDHVCNKKTINTAGTRSRWNERFMEALSLRNQKGCGRGSSVSSKSPASVRSF

SEQ ID NO: 120 - protein, 186 aa, Arabidopsis thaliana
  misc_feature (1)..(186): Public GI No. 11994583
  misc_feature (1)..(186): Functional Homolog of  Ceres CLONE ID no. 11130 at SEQ ID NO. 119 with e-value of 1.30E-99 and percent identity of 96.7
MAGGGTEAFPDLGEHCQDPDCKLLDFLPFTCDGCKLVFCLEHRSYKSHNCPKSDHGSRTVSICETCSIAIETTGFDEKGIKSLLEKHERSGDCDPNKKKKPTCPVKRCKEILTFANNLTCKYCGVKFCLKHRFPTDHVCNKKIINTAGTSSRWNERFMEALSLRNQKGCGRGSSVSSKSSPSVRSF

SEQ ID NO: 121 - protein, 192 aa, Glycine max
  misc_feature (1)..(192): Ceres CLONE ID no. 592400
  misc_feature (1)..(192): Functional Homolog of  Ceres CLONE ID no. 11130 at SEQ ID NO. 119 with e-value of 4.90E-59 and percent identity of 57.8
MASGGTEAFPDLGKHCQHRDCNQLDFLPFTCDGCQQIFCLEHRSYKSHACLKSDHNSRKVVVCEACSMSIETTGHVGQDEEAILQKHLKSGNCDPTKKKKPICPVKRCREVLTFSNTSTCKTCHIKVCLKHRFPADHACSRGASASSSACVSNGLWNNRFLTAFAKRTGQECAKNGATFSTSPPSTPSVKAY

SEQ ID NO: 122 - protein, 188 aa, Oryza sativa subsp. japonica
  misc_feature (1)..(188): Public GI No. 50900102
  misc_feature (1)..(188): Functional Homolog of  Ceres CLONE ID no. 11130 at SEQ ID NO. 119 with e-value of 1.89E-41 and percent identity of 51.9
MARRGTEAFPDLGAQCDREDCNQLDFLPFDCDGCGKTFCAEHRTYRDHGCARAADQGRTVVVCEACGDAIERRAGDGGGDDAAVLEAHARSRRCDPARKRKPRCPVPRCKETLTFSNTSGCKGCGQKVCLKHRFPADHACAGAGAGAASKAAGAAAAARSAGQCGRDAQKKEGGGWKLPQSVRNMKIF

SEQ ID NO: 123 - DNA, 1203 bp, Arabidopsis thaliana
  misc_feature (1)..(1203): Ceres CLONE ID no. 115924
  misc_feature (1)..(1203): Also Known As Ceres CDNA ID no. 23370629
  misc_feature (1)..(1203): Also Known As Ceres GEMINI ID no. 539B6
attcgtcgatcgagcgataagaagaagactggaatttttttgaggaggactctgctccatcgccgcccgccctgtaacccaccggactcagtaaactagtctgtaacacaatatcttctatttcagataagatttagcttggagaagagcaagttccgaaaatggaggggcgtcgtgtatagatccaccacccacagccctgatggaagcagacaacggaggccccaattctagtcatgcatccaaacaacgtctgcgttggacgcatgagctacatgaacgcttcgttgatgccgttgctcaacttggtggccctgatagagctacacccaaaggcgttcttagagtgatgggtgtacaaggcttaactatatatcatgtcaagagtcacttacagaaatatcgacttgcaaagtatcttccagattcgtcttctgaagggaaaaaaactgataagaaagaatctggagatatgctctctgggttggacggctcgtcgggaatgcagataactgaagccctcaagttgcagatggaagttcagaaacgattgcacgagcaactagaagtgcaaagacagctgcaactacggatagaagcacaaggaaagtacttgaagaagataattgaagagcaacaacgactcagtggagtactcggcgaaccctcagccccagtaacgggcgattcagatcctgcaacccctgccccaacatctgagtctcctcttcaagacaagtctggcaaggactgtggaccagacaaaagtctctcagttgacgagtctctctcatcttaccgggagcctttaacaccagactcagggtgtaacattgggtctccagatgagagcacaggagaggagagattatcaaagaagcctcgattggtgagaggtgcagctggttatacacctgatattgtagtgggtcacccaatactagaatcaggcttgaacacttcttaccatcagtcagaccatgtcctcgcctttgaccagccatctacatcactgcttggggccgaagaacagttggataaggtttcaggagataatctttgagttgttgagtgtaccacatgtagtgttgtttatcctaatccttattagttaggagtttcctctaataatgtgatcacaagtcgttaattctctaggcactatcacgagcatgaagaatgaatatgtctgtgttgtgctgc

SEQ ID NO: 124 - protein, 286 aa, Arabidopsis thaliana
  misc_feature (1)..(286): Ceres CLONE ID no. 115924
  misc_feature (1)..(286): Also Known As Ceres CDNA ID no. 23370629
  misc_feature (1)..(286): Also Known As Ceres GEMINI ID no. 539B6
  misc_feature (17)..(68): Pfam Name: Myb_DNA-binding Pfam Description: Myb-like DNA-binding domain
MEADNGGPNSSHASKQRLRWTHELHERFVDAVAQLGGPDRATPKGVLRVMGVQGLTIYHVKSHLQKYRLAKYLPDSSSEGKKTDKKESGDMLSGLDGSSGMQITEALKLQMEVQKRLHEQLEVQRQLQLRIEAQGKYLKKIIEEQQRLSGVLGEPSAPVTGDSDPATPAPTSESPLQDKSGKDCGPDKSLSVDESLSSYREPLTPDSGCNIGSPDESTGEERLSKKPRLVRGAAGYTPDIVVGHPILESGLNTSYHQSDHVLAFDQPSTSLLGAEEQLDKVSGDNL

SEQ ID NO: 125 - protein, 276 aa, Glycine max
  misc_feature (1)..(276): Ceres CLONE ID no. 477003
  misc_feature (1)..(276): Functional Homolog of  Ceres CLONE ID no. 115924 at SEQ ID NO. 124 with e-value of 3.90E-82 and percent identity of 79.2
  misc_feature (269)..(269): Xaa is any aa, unknown, or other
MYHSKNVPSASLIGGNSLSHGQHIDCGGSTMDPGSGGNGLSNNSNLTSKQRLRWTHELHERFVDAVAQLGGPDRATPKGVLRVMGVQGLTIYHVKSHLQKYRLAKYLPDSSSDEGKKADKKETGDMLSNLDGSSGMQITEALKLQMEVQKRLHEQLEVQRQLQLRIEAQGKYLKKIIEEQQRLSGVLSEAPGSGAVAVVPGDACQEPDNKTDPSTPDPEKAAKDRAPAKSLSIESFSSHPEPMTPDSGCHVGSPAESPKGERSAKKQRXNHGWCVF

SEQ ID NO: 126 - protein, 312 aa, Zea mays
  misc_feature (1)..(312): Ceres CLONE ID no. 894637
  misc_feature (1)..(312): Functional Homolog of  Ceres CLONE ID no. 115924 at SEQ ID NO. 124 with e-value of 1.20E-73 and percent identity of 71.8
MYSPKPESSFGPNPNSGTHQQQMELTGANMGPGNGANNNTNMAGRQRLRWTNELHERFVEAVTQLGGPDRATPKGVLRIMGVQGLTIYHVKSHLQKYRLAKYIPDASTDGNKTDNKDPGDLLAGLEGSSGLQISEALKLQMEVQKRLHEQLEVQRQLQLRIEAQGKYLQKIIEEQQRLTGVKSETPAGGASVTVSSDQFPDSERTEPSTPAPASESPTQVGASNRDTGDRTEATKSTCHGDSLSRNEPLTPDSNCQNGSPVASPNHERAAKRQRGSGTEFLDSEAEFSLPRHIFESSSGSEFQQYSMSYSGQ

SEQ ID NO: 127 - protein, 288 aa, Oryza sativa subsp. japonica
  misc_feature (1)..(288): Public GI No. 50725048
  misc_feature (1)..(288): Functional Homolog of  Ceres CLONE ID no. 115924 at SEQ ID NO. 124 with e-value of 5.30E-78 and percent identity of 69.0
MELGGNNMGPDNGANNNSNLAARQRLRWTNELHERFVEAVTQLGGPDRATPKGVLRIMGVQGLTIYHVKSHLQKYRLAKYIPDSSADGNKAENKDPGDLLAGLEGSSGLQISEALKLQMEVQKRLHEQLEVQRQLQLRIEAQGKYLKKIIEEQQRLGGVKSETPAAGASVTLPSDQFPDSERTDPSTPAPTSESPTQGVPSNRDNGGQNEATKSPQRDDSLSRHEPLTPDSNCQPGSPTASPKHERAAKRQRGNGAEFSETDFALPHSIFESSSGSEFQQCSMSYSGH

SEQ ID NO: 128 - DNA, 1425 bp, Arabidopsis thaliana
  misc_feature (1)..(1425): Ceres CLONE ID no. 116843
  misc_feature (1)..(1425): Also Known As Ceres GEMINI ID no. 554G12
aatggcgtcgacgaagcccgattccgcaatcaaccttgaagaagaggctgaaggcgacggtgtagccgtagacgatccgattttcataccggagaccacgaacttactcgtccgttactcgccattcgacgacagggacatcgattgcaatccttatttccctttcacaggcccgatttcagattctggatcaggttcttactcggattctgagcccgatcccaacagctgtcccatcgatttcttcgatcgagattcttccgatgttgacgtggctgagtacttggaatcaggagggctgaccgccggtgattataatatttggggcttttatgaccccaaggaagacgaggaagaggaggagatagttttggggacttccgggtcggatctgcaaccgggtgattcaggggagcaagggcttcgagtgaccggtatcgattcagattccgattgtgaagatggcgtgtttgattttatctctgaggatagtagcgggaataggggaaatgattcgggtcgggtcgaggttggtacgggtcttcctcctgtgtgggatcatctcttcggagagggaaccgtgttggctgatgaagaatgggaggaggtgcagaacgcgattaactggacagcttttagtggacccgaagatgaggacgaagaagatgaattgtcttcactatcaagggatgatgaagaagaagatcatgaactggactggcaggttttgttaactgttaacaatgttgttaattatatcgaacaagctgaaggaatcatgctaaatcctgatgatatcgatccggattattacctgtatctatctggtttggatgaatttgatgaaaatcagagtggacattatgatgctgatgctattcttgggcaaatgtttgatgacgagactggaatcaggggaaatcctccagcagccaaaagtgtaattcaggatcttccggttgtggagcttgctgtggaagagttagacaaagggaacaatgtttgtgcggtatgcaaagatgaaatgttagtggaggagaaagtaaggaggcttccttgtagtcatttctatcatggagagtgtatcataccttggttggggataaggaatacttgcccggtttgtcggtatgagctgcctactgatgatcttgagtatgaaagacataagagctcagaaaggggcgatactggtttggcaaggaacgtgttgccgggtagatatagttaattgaatatttgaagtgatctattcttcaagttaatagacatggtttcagaggcaagatccttgaaccactttgtttatggtaagcacttatcgtgaatgtgataatgtttaagttgtatatattccttttgttttgtgaaataaatcatgttaaactttgaacccttatcttgaagtgtttgtgaagttaattc

SEQ ID NO: 129 - protein, 409 aa, Arabidopsis thaliana
  misc_feature (1)..(409): Ceres CLONE ID no. 116843
  misc_feature (1)..(409): Also Known As Ceres GEMINI ID no. 554G12
  misc_feature (335)..(375): Pfam Name: zf-C3HC4 Pfam Description: Zinc finger, C3HC4 type (RING finger)
MASTKPDSAINLEEEAEGDGVAVDDPIFIPETTNLLVRYSPFDDRDIDCNPYFPFTGPISDSGSGSYSDSEPDPNSCPIDFFDRDSSDVDVAEYLESGGLTAGDYNIWGFYDPKEDEEEEEIVLGTSGSDLQPGDSGEQGLRVTGIDSDSDCEDGVFDFISEDSSGNRGNDSGRVEVGTGLPPVWDHLFGEGTVLADEEWEEVQNAINWTAFSGPEDEDEEDELSSLSRDDEEEDHELDWQVLLTVNNVVNYIEQAEGIMLNPDDIDPDYYLYLSGLDEFDENQSGHYDADAILGQMFDDETGIRGNPPAAKSVIQDLPVVELAVEELDKGNNVCAVCKDEMLVEEKVRRLPCSHFYHGECIIPWLGIRNTCPVCRYELPTDDLEYERHKSSERGDTGLARNVLPGRYS

SEQ ID NO: 130 - DNA, 1328 bp, Arabidopsis thaliana
  misc_feature (1)..(1328): Ceres CLONE ID no. 117089
  misc_feature (1)..(1328): Also Known As Ceres CDNA ID no. 23388445
  misc_feature (1)..(1328): Also Known As Ceres GEMINI ID no. 533H3
gtcggaaaatacggacggcgtcgtcgttctttttgacggtgtagctcaccggcgacgatttttagatttttttttaagggaaacactaagcagcaaattacaagtgggtgatttgtgtttgttacataatcttatatctaactatgtcagattctggtgagcctaaaccttctcagcaagaagagcctctacctcaacctgctgcccaagaaactcagtctcaacaagtttgcactttcttcaagaagccaacgaaaagtaaaaacataagaaaaagaaccattgacgctgatgaagaagacggagattcgaaaagcgaaagctctattctacaaaatctaaagaaagttgcaaaacccgatagcaagttatacttttcttctggaccatctaagagctctactacaacgagtggagctcctgagagatccgtctttcactacgattcatccaaggaaatccaggttcagaacgacagtggagcaacagcaacccttgaaactgagaccgacttcaatcaagacgcacgagctatccgtgagagagttcttaaaaaagcagacgaagcattgaaagggaataagaaaaaggcttctgatgagaagctgtacaaaggaattcatggatatacagatcacaaagctgggtttagaagagaacaaacaatctcgagcgagaaagctggaggctcacacgggccattaagagcttctgctcacataagagtgtcggctagatttgattaccagccagacatttgcaaggattacaaagaaaccggatactgtggatatggagattcgtgtaagttcttgcatgaccgtggggattacaaaccgggatggcagatagagaaagagtgggaagaagcagagaaagttaggaagagaaataaagctatgggagttgaggatgaagatgatgaggctgacaaggatagcgacgaagacgaaaatgcattgccctttgcttgcttcatttgcagggagccatttgttgatccagttgtcaccaaatgcaagcattacttctgtgagcattgtgctttaaagcatcacacgaagaacaagaagtgctttgtgtgtaaccaaccaacaatggggattttcaatgcagcacatgagatcaagaagagaatggctgaagaacggagtaaagctgaagaaggattgtgaagtccttgtttcactggacaaaaaggcaaaaactatatttggttatttagctttttgttttgttgtactcactggcctacatatattcattcggatgacgacgatgtttgtttcaaactgattaacttttaaatttaaacaaactgaaaattg

SEQ ID NO: 131 - protein, 343 aa, Arabidopsis thaliana
  misc_feature (1)..(343): Ceres CLONE ID no. 117089
  misc_feature (1)..(343): Also Known As Ceres CDNA ID no. 23388445
  misc_feature (1)..(343): Also Known As Ceres GEMINI ID no. 533H3
  misc_feature (201)..(227): Pfam Name: zf-CCCH Pfam Description: Zinc finger C-x8-C-x5-C-x3-H type ( and similar)
  misc_feature (277)..(314): Pfam Name: zf-C3HC4 Pfam Description: Zinc finger, C3HC4 type (RING finger)
MSDSGEPKPSQQEEPLPQPAAQETQSQQVCTFFKKPTKSKNIRKRTIDADEEDGDSKSESSILQNLKKVAKPDSKLYFSSGPSKSSTTTSGAPERSVFHYDSSKEIQVQNDSGATATLETETDFNQDARAIRERVLKKADEALKGNKKKASDEKLYKGIHGYTDHKAGFRREQTISSEKAGGSHGPLRASAHIRVSARFDYQPDICKDYKETGYCGYGDSCKFLHDRGDYKPGWQIEKEWEEAEKVRKRNKAMGVEDEDDEADKDSDEDENALPFACFICREPFVDPVVTKCKHYFCEHCALKHHTKNKKCFVCNQPTMGIFNAAHEIKKRMAEERSKAEEGL

SEQ ID NO: 132 - protein, 326 aa, Oryza sativa subsp. japonica
  misc_feature (1)..(326): Public GI No. 50907243
  misc_feature (1)..(326): Functional Homolog of  Ceres CLONE ID no. 117089 at SEQ ID NO. 131 with e-value of 9.49E-111 and percent identity of 70.9
MADGGGGGEAGSGGSAPVCSFVRKPPKNIRKRPTAPAGSDDDDEDGSGAIAAARAKKAPSSTSKLFFSSADGSSEPRRFQYESSRTIQASTDSRATATLETETEFDRDARAIRERQLKQAEESLKKNPSAPASSSGSGSGEVYKGIHGYTDYKAGFRREHTVSSEKAGGSHGPLRASAHIRLSARFDYQPDICKDYKETGYCGYGDSCKFMHDRGDYKSGWQIEKEWEEAEKARKRRIAMGGDGSDYEAGEEDDDDDEEALPFACYICREPFVDPVVTKCKHYFCEHCALKHHSKNKKCFVCNKPTLGIFNAAQEIRKKMAQDKKQ

SEQ ID NO: 133 - protein, 329 aa, Glycine max
  misc_feature (1)..(329): Ceres CLONE ID no. 478779
  misc_feature (1)..(329): Functional Homolog of  Ceres CLONE ID no. 117089 at SEQ ID NO. 131 with e-value of 1.79E-125 and percent identity of 70.1
MEDSDQPAKSAENQQTEQVCSFFRKPVNKKNIRKRTIVNEDNEEDSNNETSLLHIQKKTLKPDNKLYFSTGSSKSSASAEPSEEPGKPVFQFESSKEIQVQHDSKATATLETETEFSKDARAIRERALKQAEESLKGKSPSSKNEKLYKGMNSYKDYKAGFRREQTIASEKAGGSHGPLRASAHIRVSARFDYQPDICKDYKETGYCGYGDSCKFMHDRGDYKSGWQMEKEWEEAEKARKMRLAAGEDADEEGANLTDEDDEDSLPFACFICRNTFVDPVVTKCKHYFCEHCALKHHAKNKKCFVCNQPTLGIFNVAHEIRRKMAEDKS

SEQ ID NO: 134 - protein, 325 aa, Triticum aestivum
  misc_feature (1)..(325): Ceres CLONE ID no. 634320
  misc_feature (1)..(325): Functional Homolog of  Ceres CLONE ID no. 117089 at SEQ ID NO. 131 with e-value of 3.79E-107 and percent identity of 66.5
MSDGGGEPGAGGSAPVCNFVQKPPKNIRKRPAASVGSDDEEGSGGDDSGAIAAARSKKPPPTTSKLFFSSADNSHEPRRFQFESSRTIQSSTDNRATATLETETAYDRDARAIRERQLKQAEESLKKNPSASSSSGELYKGIHGYTDHKAGFRREHTVSGEKAGGAHGPLRASAHIRLSTRFDYQPDICKDYKETGYCGYGDSCKFMHDRGDYKSGWQLEREWDEAEKARKRRIAMRELGGSDGEAEEEDSDDEEALPFACFICREPFVDPVVTKCKHYFCEHCALKHHSKNKKCFVCNKPTLGIFNAAQEIRKKIAQDKKQQDL

SEQ ID NO: 135 - DNA, 1171 bp, Arabidopsis thaliana
  misc_feature (1)..(1171): Ceres CLONE ID no. 119104
  misc_feature (1)..(1171): Also Known As Ceres CDNA ID no. 23376381
  misc_feature (1)..(1171): Also Known As Ceres GEMINI ID no. 554C9
gtataatcaaatcctctttatctttcattgtttcgcgtgaattagctctgcaaagggctcttcattcttctcgcttggattcctctgcacaaaagaaaaaagaccatggatgatcttcatggaagaaatggtcgaatgcacattggtgtagcgcaaaatccaatgcatgtgcagtatgaagatcacggtttgcaccatatcgacaatgaaaacggtatgatggatgaccatgctgatggtgggatggatgaaggagtggagacagacattccttctcaccctggaaactcagctgataatcgtggtgaagttgtagaccgtggaattgaaaatggagatcaattgacattgtccttccagggacaagtttatgtttttgaccgtgtctcgcctgagaaggttcaagctgtgcttttgttacttggtggaagggaagtaccacatacactcccaacaaccctaggatcacctcatcagaacaataggggtctatctggtactcctcaacggcttagcgttccgcagcggttagcttctttgctcaggtttagggagaaacgaaaagggaggaactttgataagactattcgctatacagtcaggaaagaagtagccctgagaatgcagcgtaagaaaggtcagttcacgtcggctaaatcaagcaatgatgattctggatccactggatcggattgggggtcaaaccagagctgggccgtagaagggactgagactcagaagccagaggttttatgtcgacactgtggaacaagtgagaagtcaactccaatgatgcgacgtggacctgatgggccaagaacactttgtaatgcgtgtggactgatgtgggcaaacaaggggactcttagagacctatccaaagtccctcctccgcaaacacctcagcatctatctgtgaataagaatgaggacgcaaatcttgaggctgatcaaatgatggaagtaactggtgacattagcaacacacagtgagaactgagaaaccattggaagcaagaaaggatctcaaacaaaaacagttgttatcatttcatttgatgatggaatcgaatctgagttgtgtttactctgggttaatctcagtctatgtgggcacattttagtcttctacaaattataagacactcttcacttatttagaagctcactc

SEQ ID NO: 136 - protein, 295 aa, Arabidopsis thaliana
  misc_feature (1)..(295): Ceres CLONE ID no. 119104
  misc_feature (1)..(295): Also Known As Ceres CDNA ID no. 23376381
  misc_feature (1)..(295): Also Known As Ceres GEMINI ID no. 554C9
  misc_feature (147)..(185): Pfam Name: CCT Pfam Description: CCT motif
  misc_feature (217)..(254): Pfam Name: GATA Pfam Description: GATA zinc finger
  misc_feature (73)..(108): Pfam Name: Zim Pfam Description: ZIM motif
MDDLHGRNGRMHIGVAQNPMHVQYEDHGLHHIDNENGMMDDHADGGMDEGVETDIPSHPGNSADNRGEVVDRGIENGDQLTLSFQGQVYVFDRVSPEKVQAVLLLLGGREVPHTLPTTLGSPHQNNRGLSGTPQRLSVPQRLASLLRFREKRKGRNFDKTIRYTVRKEVALRMQRKKGQFTSAKSSNDDSGSTGSDWGSNQSWAVEGTETQKPEVLCRHCGTSEKSTPMMRRGPDGPRTLCNACGLMWANKGTLRDLSKVPPPQTPQHLSVNKNEDANLEADQMMEVTGDISNTQ

SEQ ID NO: 137 - protein, 357 aa, Zea mays
  misc_feature (1)..(357): Ceres CLONE ID no. 337006
  misc_feature (1)..(357): Functional Homolog of  Ceres CLONE ID no. 119104 at SEQ ID NO. 136 with e-value of 1.99E-54 and percent identity of 57.5
MSHHDGSKPYQPRRGPERHPQPADGIAAPPPAAVAPSVEHLVAAAAEAEALNRFAAEQQQQLQGHEQEVGEEEEEEDEQEDEMEEEDEDEHEGQHGGIGGEHVPMDADAAAAAAAAAVSQMDPHSALVAGTVPPMATNQLTLSFQGEVYVFDSVSPDKVQAVLLLLGGRELSSLGGASSSAPYSKRLNYPHRVASLMRFREKRKERNFDKKIRYSVRKEVALRMQRNRGQFTSSKPKPDEIAASEMASADGSPNWALVEGRPPSAAECHHCGTNATATPMMRRGPDGPRTLCNACGLMWANKGLLRDVTKSPVPLQATQSAPHLDGGNGSAMSAPGSELENAAAAMTNGHESSSSGV

SEQ ID NO: 138 - protein, 362 aa, Zea mays
  misc_feature (1)..(362): Ceres CLONE ID no. 220709
  misc_feature (1)..(362): Functional Homolog of  Ceres CLONE ID no. 119104 at SEQ ID NO. 136 with e-value of 3.40E-51 and percent identity of 65.1
MSHSHHDGSKPYQPRRGPERSPQPADGIAVPPPAAVAPSVEHLVAAAAEAEALSRLGAEQQQLLQGHEHEVGEEEGEDEEEDEMEDDDDDDDEQEGQHGGIGVEHVPMDADAAAAAAVAAAGAQMDPHSVLVPGTVPPMATNQLTLSFQGEVYVFDSVSPDKVQAVLLLLGGRELSSLSGASSSAPYSKRLNFPHRVASLMRFREKRKERNFDKKIRYNVRKEVALRMQRNRGQFTSSKPKPDEIAASEMAAADGSLNWALVEGRPPSAAECHHCGINATATPMMRRGPDGPRTLCNACGLMWANNGLLRDLSKSPVPLHSIQQSAPILNGGNGSAMSALGSELENAAAAMGNGHEPSGSGV

SEQ ID NO: 139 - protein, 340 aa, Oryza sativa subsp. japonica
  misc_feature (1)..(340): Public GI No. 53792087
  misc_feature (1)..(340): Functional Homolog of  Ceres CLONE ID no. 119104 at SEQ ID NO. 136 with e-value of 3.60E-56 and percent identity of 58.5
MSHHDGSKPYQPRRGPERPPPPAPADDAAAHVAPTVDHLAAVAAEAEAMARFEEEHRALGAEEEYEEEEDELEEEEEEMEEDEDAQHHEGVGGEVAVPMDAEAAAQLDPHGGMLAASGAVQPMASNQLTLSFQGEVYVFDSVSPDKVQAVLLLLGGRELNPGLGSGASSSAPYSKRLNFPHRVASLMRFREKRKERNFDKKIRYSVRKEVALRMQRNRGQFTSSKPKGDEATSELTASDGSPNWGSVEGRPPSAAECHHCGINAKATPMMRRGPDGPRTLCNACGLMWANKGMLRDLSKAPPTPIQVVASVNDGNGSAAAPTTEQEIPAPATVNGHESST

SEQ ID NO: 140 - DNA, 918 bp, Arabidopsis thaliana
  misc_feature (1)..(918): Ceres CLONE ID no. 120947
  misc_feature (1)..(918): Also Known As Ceres GEMINI ID no. 539C7
aaaagaaagaaaaaaatgccttcttttgcttttggatctcatcaccatttggcgaatcctacagactcgccgccgtactccgtcgaaattagcatcgacggtgactcctccgacttggattctttgtctcaggtcgatttagagtccggcggtgtaccggcgccggagaaacagctacattccggtggtaagaagaggagaactaggaggagaaagaggaggaagaagaagaagaagaagaaaggtggaagagattgcaggatctgtcatcttcctttagagactaacaaagaagctgaagatgaagatgaagaagaagaagatgattctgatgatgatgaagatgaagaagatgaagaagaagaagaagaagaagaagaatattatggtttgcctttgcaattaggttgctcttgtaaaggtgatttgggtgttgctcatagtaagtgtgctgagacttggtttaagatcaaaggaaacatgacatgtgagatatgcggcgcaatggctctaaacgtggctggtgaacaatctaatccggagagcactgcttctacacattcacaagcagctgcgggacaatctctaactcagacagagccacgaggaatctggcatggtcgccctgttatgaacttcttacttgctgctatggtcttcgccttcgttgtttcttggctttttcacttcaaagtcctcaagtgaaacgttttccatctctctctctctctctctttcgcccacccgcacgagctcactcttctcctgttcttgagccgcttgcaatcgctgaatcaatccctcctgttgcttgattattcacacgttttgtagctgtaaaaacttggtagtgtttagattgttgtaacttgtgagatttacattttgtataatattgttctctgctccggcttcgtg

SEQ ID NO: 141 - protein, 229 aa, Arabidopsis thaliana
  misc_feature (1)..(229): Ceres CLONE ID no. 120947
  misc_feature (1)..(229): Also Known As Ceres GEMINI ID no. 539C7
  misc_feature (81)..(161): Pfam Name: zf-C3HC4 Pfam Description: Zinc finger, C3HC4 type (RING finger)
MPSFAFGSHHHLANPTDSPPYSVEISIDGDSSDLDSLSQVDLESGGVPAPEKQLHSGGKKRRTRRRKRRKKKKKKKGGRDCRICHLPLETNKEAEDEDEEEEDDSDDDEDEEDEEEEEEEEEYYGLPLQLGCSCKGDLGVAHSKCAETWFKIKGNMTCEICGAMALNVAGEQSNPESTASTHSQAAAGQSLTQTEPRGIWHGRPVMNFLLAAMVFAFVVSWLFHFKVLK

SEQ ID NO: 142 - protein, 197 aa, Arabidopsis thaliana
  misc_feature (1)..(197): Public GI No. 9759231
  misc_feature (1)..(197): Functional Homolog of  Ceres CLONE ID no. 120947 at SEQ ID NO. 141 with e-value of 4.50E-97 and percent identity of 98.9
MPSFAFGSHHHLANPTDSPPYSVEISIDGDSSDWDSLSQVDLESGGVPAPEKQLHSGGKKRRTRRRKRRKKKKKKKGGRDCRICHLPLETNNGLPLQLGCSCKGDLGVAHSKCAETWFKIKGNMTCEICGAMALNVAGEQSNPESTASTHSQAAAGQSLTQTEPRGIWHGRPVMNFLLAAMVFAFVVSWLFHFKVLK

SEQ ID NO: 143 - DNA, 1385 bp, Arabidopsis thaliana
  misc_feature (1)..(1385): Ceres CLONE ID no. 123905
  misc_feature (1)..(1385): Also Known As Ceres GEMINI ID no. 532D4
gaaaacaaaaacacaaacaaaactcatattttcaatctccaggtgctttacaccaacagagtcgcaagaaaacaaaaaccaaactcggatttagtttgacagaagaaggaatcgagagtcgggtatgcattatcctaacaacagaaccgaattcgtcggagctccagccccaacccggtatcaaaaggagcagttgtcaccggagcaagagctttcagttattgtctctgctttgcaacacgtgatctcaggggaaaacgaaacggcgccgtgtcagggtttttccagtgacagcacagtgataagcgcgggaatgcctcggttggattcagacacttgtcaagtctgtaggatcgaaggatgtctcggctgtaactactttttcgcgccaaatcagagaattgaaaagaatcatcaacaagaagaagagattactagtagtagtaacagaagaagagagagctctcccgtggcgaagaaagcggaaggtggcgggaaaatcaggaagaggaagaacaagaagaatggttacagaggagttaggcaaagaccttggggaaaatttgcagctgagatcagagatcctaaaagagccacacgtgtttggcttggtactttcgaaaccgccgaagatgcggctcgagcttatgatcgagccgcgattggattccgtgggccaagggctaaactcaacttcccctttgtggattacacgtcttcagtttcatctcctgttgctgctgatgatataggagcaaatgcaagtgcaagcgccagtgtgagcgccacagattcagttgaagcagagcaatggaacggaggaggaggggattgcaatatggagtggatgaatatgatgatgatgatggattttgggaatggagattcttcagattcaggaaatacaattgctgatatgttccagtgataaatgagctctttcttgttggcgttttttggagttaagtgcaagaagagattgacactgtggcttgtttaaagtgaacaagaacaagaaagcatgtaattagtagtctcattcttttgtttgtggtcaattctatgtttatctcatataaaatctgagttaaacctatctgaggagagagtaaataaagaggttaagaaacccaacattggtctgaattataaacgtaagtgtcaacgttgtttataaaggagaaaactataattggtgacaaaagacataaagaaaagatgtctactcctacaaagcatcgcgtgcagctattcgacaaacaatggcatctcccagagaggaaattccgagctcttggctagttatcttgtaatgctgaaaacatgaatgtatttgagtttatttctgtaacattggaagcgaaataaaagggttatcaactgtt

SEQ ID NO: 144 - protein, 267 aa, Arabidopsis thaliana
  misc_feature (1)..(267): Ceres CLONE ID no. 123905
  misc_feature (1)..(267): Also Known As Ceres GEMINI ID no. 532D4
  misc_feature (134)..(197): Pfam Name: AP2 Pfam Description: AP2 domain
MHYPNNRTEFVGAPAPTRYQKEQLSPEQELSVIVSALQHVISGENETAPCQGFSSDSTVISAGMPRLDSDTCQVCRIEGCLGCNYFFAPNQRIEKNHQQEEEITSSSNRRRESSPVAKKAEGGGKIRKRKNKKNGYRGVRQRPWGKFAAEIRDPKRATRVWLGTFETAEDAARAYDRAAIGFRGPRAKLNFPFVDYTSSVSSPVAADDIGANASASASVSATDSVEAEQWNGGGGDCNMEWMNMMMMMDFGNGDSSDSGNTIADMFQ

SEQ ID NO: 145 - protein, 266 aa, Triticum aestivum
  misc_feature (1)..(266): Ceres CLONE ID no. 634402
  misc_feature (1)..(266): Functional Homolog of  Ceres CLONE ID no. 123905 at SEQ ID NO. 144 with e-value of 1.80E-36 and percent identity of 45.0
MTFSVSPATGASQEYMIRFDGHFEDPSSAAASAEPPLPFAGRAFSPQQEQSAMVAALLHVVSGYTTPAPDLFFPARKEACTACGMDGCLGCEFFGAEAGRAVAASDAPRAPAAGGPQRRRRNKKNQYRGVRQRPWGKWAAEIRDPRRAVRVWLGTFDTAEDAARAYDRAAVEFRGPRAKLNFSFPEQQQQQLGGSGNAAAKSDACSPSPSPRSADEDETGDLLWDGLVDLMKLDESDLCLLLPVDNTDKFHIEGKRRSGSGVPLCY

SEQ ID NO: 146 - protein, 256 aa, Zea mays
  misc_feature (1)..(256): Ceres CLONE ID no. 1494990
  misc_feature (1)..(256): Functional Homolog of  Ceres CLONE ID no. 123905 at SEQ ID NO. 144 with e-value of 4.19E-37 and percent identity of 49.2
MEASRQYMIRFDGHFEEGPSSAAAEPPQPFASRAFSPEQEQSVMVAALLHVVSGYATPAPDLFFPAGKEACTACGVDGCLGCEFFGAEAGRAVAASDAPRAATAGGPQRRRRNKKSQYRGVRQRPWGKWAAEIRDPRRAVRVWLGTFDTAEDAARAYDRAAVKFRGPRAKLNFSFPEQHLRDDSGNAAAKSDACSPSPSPRSAEEEETGDLLWDGLVDLMKLDESDLCLLLPVDNTLDKFHAPGQRRSGSGVPLCY

SEQ ID NO: 147 - protein, 274 aa, Oryza sativa subsp. japonica
  misc_feature (1)..(274): Public GI No. 51536200
  misc_feature (1)..(274): Functional Homolog of  Ceres CLONE ID no. 123905 at SEQ ID NO. 144 with e-value of 3.09E-34 and percent identity of 43.4
MTKKVIPAMAAARQDSCKTKLDERGGSHQAPSSARWISSEQEHSIIVAALRYVVSGCTTPPPEIVTVACGEACALCGIDGCLGCDFFGAEAAGNEEAVMATDYAAAAAAAAVAGGSGGKRVRRRRKKNVYRGVRHRPWGKWAAEIRDPRRAVRKWLGTFDTAEEAARAYDRAALEFRGARAKLNFPCSEPLPMPSQRNGNGGDAVTAATTTAEQMTPTLSPCSADAEETTTPVDWQMGADEAGSNQLWDGLQDLMKLDEADTWFPPFSGAASSF

SEQ ID NO: 148 - DNA, 1753 bp, Arabidopsis thaliana
  misc_feature (1)..(1753): Ceres CLONE ID no. 125922
  misc_feature (1)..(1753): Also Known As Ceres CDNA ID no. 23365512
  misc_feature (1)..(1753): Also Known As Ceres GEMINI ID no. 539G7
ttttcatttttctccctttctcactctaacagacccatccatcgctctctctctgtgaaactatcatcttcctcttctccggcgacgttttggaagttctgggaggttcgatctagaaagggattgttgtgcctgtgttctactgaagtgtctctcgtcaaataatttataagcactgtctttgcatagtgcttagtaggtgctagttatggggaatgcgtgttgtgttgctgctcgagacaaaatggtggtgcctaattcatcagctggtgagaatttgcagaggagcaatatcaggcattctccgtcttggagtttccggtgggataatagagggcgtgtagctggtgaagaaacttctctcagttggttatctgatggtattagtcggaacgatggctctgagatcaaatttgaatctgctttcgtatcatctgaagggtcccctttggacagttttcggacacagacattgcaaaaatctcctgcctcagatctatcttttccaagaaattcttccatgaatacagtcttcgaacagaaagaaaatgtttcaacagagtctgcagcaccatcatatctatctcctgcacagttgtctctttcactagcttcacaaccatcatctttccctacgtcaccactttcgtcccaaagctacttgcaccctgcaagttcatctacacttaaactgacacagcaccctcgtctatcaaagcaagtctcagatggtcaaatctatggtcagaactcactaagtagaagctcagcaactgaagagaggcagggaactcctacgagatatgattcgtctcagtctggaccatctgaaggttggtctctacaagccttttctgaaatgatgtcatcttctcgcagcaacaaggctctgtcttatgacaattatgacaatgattgttttgggcttcaacgtgacaagattgaccatcatggcaaccggatgtccaagcatcagcagcatacctgcggtgcttgctctagactcttgtcggagaaatccttgtggagcagccaaaagatctttatgaccaacgagctctctgtatctgcaattctagcttgtgggcatgtctatcatggggagtgtttagagcagatgacgccggaaattgataaattcgacccttcatgcccaatatgtacaatgggtgagaagaaaacagcgaagctgtcagagaaagcgttgaaagtagagatggatttgaaagcgagacacaacaaaagactcagaaaccgagttttggacagtgactttgattgcgatgattttgtaatgtttgaccacagccacaggacagcagcagcagcaagcaagagccctagactcgtctcaagttcgagtgctaaaagctattcagcaaagcctttcttggctcgacacttctctttcgggtccagaagtaactataaatcccctaaagaaaatcttcctgtgaaaaagaaaggcttcttctggaccaaatccagcaaaatatgaacttatttcgccgtgctctgtactttgactgctgtctgaagcatagaagtcgacacacaccggggcacgataccattcagttaaaagcagtctatttgctgttacacacttgctcaacaaagtcttctcattgtttttttttttaatgaatactaaattttcacacatgtaaagttacaaatttagattacaaggttggggacaaaaaaaaaaaaaacattggatcattaatctattgatttgttctggctgtgc

SEQ ID NO: 149 - protein, 429 aa, Arabidopsis thaliana
  misc_feature (1)..(429): Ceres CLONE ID no. 125922
  misc_feature (1)..(429): Also Known As Ceres CDNA ID no. 23365512
  misc_feature (1)..(429): Also Known As Ceres GEMINI ID no. 539G7
  misc_feature (289)..(318): Pfam Name: zf-C3HC4 Pfam Description: Zinc finger, C3HC4 type (RING finger)
MGNACCVAARDKMVVPNSSAGENLQRSNIRHSPSWSFRWDNRGRVAGEETSLSWLSDGISRNDGSEIKFESAFVSSEGSPLDSFRTQTLQKSPASDLSFPRNSSMNTVFEQKENVSTESAAPSYLSPAQLSLSLASQPSSFPTSPLSSQSYLHPASSSTLKLTQHPRLSKQVSDGQIYGQNSLSRSSATEERQGTPTRYDSSQSGPSEGWSLQAFSEMMSSSRSNKALSYDNYDNDCFGLQRDKIDHHGNRMSKHQQHTCGACSRLLSEKSLWSSQKIFMTNELSVSAILACGHVYHGECLEQMTPEIDKFDPSCPICTMGEKKTAKLSEKALKVEMDLKARHNKRLRNRVLDSDFDCDDFVMFDHSHRTAAAASKSPRLVSSSSAKSYSAKPFLARHFSFGSRSNYKSPKENLPVKKKGFFWTKSSKI

SEQ ID NO: 150 - DNA, 1114 bp, Arabidopsis thaliana
  misc_feature (1)..(1114): Ceres CLONE ID no. 12997
  misc_feature (1)..(1114): Also Known As Ceres CDNA ID no. 23389866
  misc_feature (1)..(1114): Also Known As Ceres GEMINI ID no. 555E5
accagtcttcttcttcttcctccaaactctctctttctctctcgagaaccttaagaaaacgttacaaatggctgttgaagcaagacacatgaatctcttctcttctcaatacattaccaacagagaatgtgttaaatctcaaacgaatatgaacaacggacaacaaatcgccggcggtggttttccgttaacaatcggtgatcggaatttacagtacatagatccgattaacagcttcaacaaatcagaaagcgagctcacagctatttcaaaacgtcagagagattcaacgtttgattcagacgctttaatcgcatctcagaaacgcagagcaatcgcgttttctccggcgtcattaatcgacgcagagttagtttcacagatccaacagcaaaactcagaaatcgatagattcgtagcgcaacaaacggaaacgttgagaatcgaattagaagcgagacaaagaacgcaaacgcggatgttagcgtcagcggtacaaaacgcgatattgaaaaagctgaaagcgaaagacgaagagattataagaatggggaaattaaactgggttttacaagaacgtgtgaagaatctctacgtagagaatcagatctggcgtgatttagcacaaactaatgaagctactgctaataatctcagatcaaatctcgaacaagttttagctcaagtcgatgatttagatgcgtttcgtcgtcctttggttgaagaagctgatgatgcagaatctagctgtggaagctgtgacggaggtgatgtaacggcggttgttaacggaggatgtaaacggtgcggtcaattaacggcgagtgtgttggtgttgccttgtcgtcatttgtgtttgtgtacggtttgtggatcgtcggctttgttacggacgtgtcctgtatgtgatatggtcatgactgctagtgtacatgttaacatgtcatcatgaccattttatttatttttttcaagttaaaaagtttagttttattgttttgatttgaggattaaagagtaaaattaggtgaaaaacaaaagaagaagaaatgtgactcttttttgactttttttggagacttttaaagatggaattgattcattatttgtttgc

SEQ ID NO: 151 - protein, 294 aa, Arabidopsis thaliana
  misc_feature (1)..(294): Ceres CLONE ID no. 12997
  misc_feature (1)..(294): Also Known As Ceres CDNA ID no. 23389866
  misc_feature (1)..(294): Also Known As Ceres GEMINI ID no. 555E5
MAVEARHMNLFSSQYITNRECVKSQTNMNNGQQIAGGGFPLTIGDRNLQYIDPINSFNKSESELTAISKRQRDSTFDSDALIASQKRRAIAFSPASLIDAELVSQIQQQNSEIDRFVAQQTETLRIELEARQRTQTRMLASAVQNAILKKLKAKDEEIIRMGKLNWVLQERVKNLYVENQIWRDLAQTNEATANNLRSNLEQVLAQVDDLDAFRRPLVEEADDAESSCGSCDGGDVTAVVNGGCKRCGQLTASVLVLPCRHLCLCTVCGSSALLRTCPVCDMVMTASVHVNMSS

SEQ ID NO: 152 - protein, 323 aa, Zea mays
  misc_feature (1)..(323): Ceres CLONE ID no. 465893
  misc_feature (1)..(323): Functional Homolog of  Ceres CLONE ID no. 12997 at SEQ ID NO. 151 with e-value of 5.80E-33 and percent identity of 44.3
  misc_feature (277)..(277): Xaa is any aa, unknown, or other
  misc_feature (279)..(279): Xaa is any aa, unknown, or other
MAVEAHRLLLAGGHRQQQQQQQLASAGWPWAGADEDRCATTARPSQHHHHQQQQPQQELRLHNASCVGVLAPRVSTIAAGGQMFLGDAAESDVTFGGGGAAARQEVTAVAPAPKRRKRAEQQQTPPVFQVCAADDVAAQFQQHIVDVNRLVFQQTANMWAALTELRRRQARQVVAAVEAAAATRLRAREEEVQRTARINGTLEERARSLYVEAQLWRDLARANEATANELRAELQQALDDQRTRGAPGAGADADDAGSCCRGGEDGGTGTSLARTCXVXGLSAADVLLLPCRHLCACAPCAGAARACPACGCAKNGSVCVNFS

SEQ ID NO: 153 - DNA, 1094 bp, Arabidopsis thaliana
  misc_feature (1)..(1094): Ceres CLONE ID no. 13930
  misc_feature (1)..(1094): Also Known As Ceres CDNA ID no. 23369276
  misc_feature (1)..(1094): Also Known As Ceres GEMINI ID no. 535G10
atcgccggcgttagggttgtttttctcaacaatggtgtctctggccaagtttcactactgtgatcaaacactccacctccgactcgacactcaccgtaaaccgcagcctaaacctgtttcataccgaatcttacataaacctcctccttctcgcgtcatcagagcttcttcgttttcatcaaaccctaaaccctctttcctcaaaaccacctgcgtgaccttaacaacagccgccgctttactctccgcttccctccacctctccaccaaacccgtcaccgcagcaactctcgtctcacctcctcctccaccatccacggcggcggatctcacttccgatcaaatctcgtcgcgtccaaaggaagaagaagaagaagcagcgctggagaagcacctcactaagaatccaaacgacgtcgaagctcttcaatcactgatgaaaatcaaattccaaaccaaaaacatcgaccacgccttagagattctaaaccgtttgatcgaaatccaacccgaagaacaagaatggcggatcctaaaagctcaggtacaaacctacggcggcgatttcgattcagcgacgaaaggattcgaagaggttctatctaaagatccatttcgtgtagaagcttatcacggattagtaatggcttactccgaatccgaatcgaaattatcagagatcgagagtagaatcaacgaagcgattgagaaatgcaagaaggagaacaagaaagattttagagatttcatgttgttgattgctcagattagggttatcaaaggtaatccaattgaagcacttagggtttatcaagagttggtgaaagatgagcctaaagactttagaccatatctatgtcaaggtttgatttatacattgatgaagaagaaagatgaagcagagaagcaatttgcagagtttagaagattggttcctgagaatcatccttacaaagagtatttagatgctaatgtactcaatactaacaagcttttcgctaagaatcagtgaaaatttgtgtttttgtttgaatatgcttagaaatgtgactttgaacttttatttgtgatcactgcgaaattattctactacc

SEQ ID NO: 154 - protein, 326 aa, Arabidopsis thaliana
  misc_feature (1)..(326): Ceres CLONE ID no. 13930
  misc_feature (1)..(326): Also Known As Ceres CDNA ID no. 23369276
  misc_feature (1)..(326): Also Known As Ceres GEMINI ID no. 535G10
  misc_feature (271)..(304): Pfam Name: TPR_2 Pfam Description: Tetratricopeptide repeat
MVSLAKFHYCDQTLHLRLDTHRKPQPKPVSYRILHKPPPSRVIRASSFSSNPKPSFLKTTCVTLTTAAALLSASLHLSTKPVTAATLVSPPPPPSTAADLTSDQISSRPKEEEEEAALEKHLTKNPNDVEALQSLMKIKFQTKNIDHALEILNRLIEIQPEEQEWRILKAQVQTYGGDFDSATKGFEEVLSKDPFRVEAYHGLVMAYSESESKLSEIESRINEAIEKCKKENKKDFRDFMLLIAQIRVIKGNPIEALRVYQELVKDEPKDFRPYLCQGLIYTLMKKKDEAEKQFAEFRRLVPENHPYKEYLDANVLNTNKLFAKNQ

SEQ ID NO: 155 - DNA, 1309 bp, Arabidopsis thaliana
  misc_feature (1)..(1309): Ceres CLONE ID no. 141875
  misc_feature (1)..(1309): Also Known As Ceres GEMINI ID no. 532G10
aacttagggtttataaagttccaagctttatccatggcgtaagatgattcaccttctcaaagtttgatccttttttcatatctgatcaaaggagagttttgggtttgatttctaattgttaaagttttaatctttttatttgggtttgtgttcgattatgtggatggctactcaatcaaattctgggttcgattctttgagttctatgatgagtcgtcacgctattaatttccaatctaacacttcttcggagatgactccaatgagtccgtacttggggatgaatatgaatatgatcaatgttggttctcctggttttcttcaaaccgggaattcttcgaatggttccgattcgggttctggtctaaagcttgatacttccatggttagtgaatggtcaaatgaagaacaatacatattggatgctggtcttgaaaaatataaggatatgccaagtattgatatgtatattcaaattggaaacactttacctgataaaagtattcgagatattgctttgcggtgtaggtggctgaggagaaagagaagaaaatcagaagaattaaactgtggaagaagagcaagttctagcaagggcaagcaggtggaatcgtcgtctaagtcaagcattccctctgttttgcctcataacatggcttcatatcctttctcagggccatctacaagcaccagtaaacaaattacgtctgaagatttaagtagctatgcaacaaatcttatagaacagaatgtacgagcttttagtcaaattagagctaatctctcctcatataaggcaggggataacctagatctctttcgtcaggcaaggaacaaccttatcaccatccaaaatgagataaataatatgcctggattgatgaacaagatgccaccattgccagtcacaatcaatgatgatctctcggtgatgatgccattcaatacgatgcaaagtggcggcttccataggaagtagaagtcttaggaaatcatctggtttcccttagttacctgtaaattatcctaaagaagctggaggaggtataaaaaagctcatcaaatgttgggaagtttgtagaaatgtgattctttcgtaacaccaacgatctttattgctgcgcgggatgttgaaacaagacataatataacgaatgtaggggttcttggtcctggctcctaactaaaaaaccttcttaacaagttctattagataaacttagttcaattagtgtcttggagaatttctaagcgatcgatgtgtataaaaaaagattctattgaagagcgtgttgagatttgcatcttt

SEQ ID NO: 156 - protein, 273 aa, Arabidopsis thaliana
  misc_feature (1)..(273): Ceres CLONE ID no. 141875
  misc_feature (1)..(273): Also Known As Ceres GEMINI ID no. 532G10
MWMATQSNSGFDSLSSMMSRHAINFQSNTSSEMTPMSPYLGMNMNMINVGSPGFLQTGNSSNGSDSGSGLKLDTSMVSEWSNEEQYILDAGLEKYKDMPSIDMYIQIGNTLPDKSIRDIALRCRWLRRKRRKSEELNCGRRASSSKGKQVESSSKSSIPSVLPHNMASYPFSGPSTSTSKQITSEDLSSYATNLIEQNVRAFSQIRANLSSYKAGDNLDLFRQARNNLITIQNEINNMPGLMNKMPPLPVTINDDLSVMMPFNTMQSGGFHRK

SEQ ID NO: 157 - DNA, 850 bp, Arabidopsis thaliana
  misc_feature (1)..(850): Ceres CLONE ID no. 14234
  misc_feature (1)..(850): Also Known As Ceres CDNA ID no. 23367680
  misc_feature (1)..(850): Also Known As Ceres GEMINI ID no. 535F2
ctctctgtttctctcattacccatctagcaaaattcaagaatcgaactagggctacgaaatatttcgattttgaatctccaaatccagaactcgagtgttaaatcttcgaaaagatcaaatctttggagatgggtctttgggattcacttcttaattggctccggagcttgtttttcaaacaagagatggagctgtcactcgttggacttcaaaatgctgggaagacttctcttgtcaatgccattgctactggaggttacagtgaagatatgataccaactgtaggatttaacatgaggaaagttacaaaaggaaatgttacaataaagatttgggatcttggagggcaacgaaggtttcgtaccatgtgggaacgttactgtcgcggtgtttccgccattgtatatgtgattgatgctgcagatcgagatagtgtaccgatatcaagaagcgaattgaatgatctgctaacgaaaccgtctttaaatggcattcctcttctgattcttggcaacaaaatcgacaagtctgaagctctctctaagcaagctttggttgatcaactagggcttgaatctgtaacagacagagaggtttgctgttacatgatctcgtgtaaggactcgataaacattgatgcggtcatcgattggctcattaagcactcgagaactgccacataaacagacacaacaagctcattggtctagaggaaaacaaagcttgtttttggtttcttgatgttgttttatttgttgagaatcaatcagatgtaaatcatcagcttttggtttcttcttggtttaaatcttgttttacaattcttcaatgttcaaatacttccggttc

SEQ ID NO: 158 - protein, 184 aa, Arabidopsis thaliana
  misc_feature (1)..(184): Ceres CLONE ID no. 14234
  misc_feature (1)..(184): Also Known As Ceres CDNA ID no. 23367680
  misc_feature (1)..(184): Also Known As Ceres GEMINI ID no. 535F2
  misc_feature (20)..(40): Pfam Name: MMR_HSR1 Pfam Description: GTPase of unknown function
MGLWDSLLNWLRSLFFKQEMELSLVGLQNAGKTSLVNAIATGGYSEDMIPTVGFNMRKVTKGNVTIKIWDLGGQRRFRTMWERYCRGVSAIVYVIDAADRDSVPISRSELNDLLTKPSLNGIPLLILGNKIDKSEALSKQALVDQLGLESVTDREVCCYMISCKDSINIDAVIDWLIKHSRTAT

SEQ ID NO: 159 - protein, 184 aa, Triticum aestivum
  misc_feature (1)..(184): Ceres CLONE ID no. 567499
  misc_feature (1)..(184): Functional Homolog of  Ceres CLONE ID no. 14234 at SEQ ID NO. 158 with e-value of 5.79E-88 and percent identity of 90.8
MGLWDSLLNWLRSLFFKQEMELSLVGLQNAGKTSLVNSIATGGYSEDMIPTVGFNMRKVTKGNVTIKLWDLGGQRRFRTMWERYCRGVTAILYVVDAADRDSVPIAKSELHDLLTKQSLSGIPLLILGNKIDKSEALSKPALVDQLGLESIKDREVCCYMISCKDSVNIDVVIDWLIKHSKTAN

SEQ ID NO: 160 - protein, 184 aa, Zea mays
  misc_feature (1)..(184): Ceres CLONE ID no. 361163
  misc_feature (1)..(184): Functional Homolog of  Ceres CLONE ID no. 14234 at SEQ ID NO. 158 with e-value of 1.20E-87 and percent identity of 90.7
MGLWDSLLNWLRSLFFKQEMELSLVGLQNAGKTSLVNAVATGGYSEDMIPTVGFNMRKITKGNVTIKLWDLGGQRRFRTMWERYCRGVSAILYVVDAADRDSIPIAKSELLDLLTKQSLAGIPLLVLGNKIDKSEALSKQALVDQLGLELIKDREVCCYMISCKDSVNIDVVIDWLIKHSRTAK

SEQ ID NO: 161 - protein, 184 aa, Oryza sativa subsp. japonica
  misc_feature (1)..(184): Public GI No. 50912455
  misc_feature (1)..(184): Functional Homolog of  Ceres CLONE ID no. 14234 at SEQ ID NO. 158 with e-value of 7.39E-88 and percent identity of 90.7
MGLWDSLLNWLRSLFFKQEMELSLVGLQNAGKTSLVNAVATGGYSEDMIPTVGFNMRKVTKGNVTIKLWDLGGQRRFRTMWERYCRGVSAILYVVDAADRDSIPIAKSELHDLLTKQSLAGIPLLVLGNKIDKSEAVSKQALVDQLGLELIKDREVCCYMISCKDSVNIDVVIDWLIKHSRTAK

SEQ ID NO: 162 - DNA, 1451 bp, Arabidopsis thaliana
  misc_feature (1)..(1451): Ceres CLONE ID no. 14246
  misc_feature (1)..(1451): Also Known As Ceres CDNA ID no. 23657254
  misc_feature (1)..(1451): Also Known As Ceres GEMINI ID no. 532D11
atatttttgtgattagaaattaggatcttacagaaatctttcaaaaagaaattcataacagttccattttttttggtaagattcataaaaaaattcaagttaaatgcattttataaaaatgtaggaaaaactttcaacaaaaatcgttgagaagaacatacagtatatcttatccactctcttcctcatccacgcggcaaaggcacaaacctctttagaaaaatgtcgtcagcttattgttcctccgccgtggctgtatccgccgcagccaccgcttcctccgccgctacctttaatccattactctcctcccactccaattcccaactcttctatcgctttacaccaaaatccttcaaactcgttgccaattgccctaatccactaatcctccactcaaatatccgccgccaccgcttcttctgcgccgccgaaaccgaagctagttccgccgatgatgaaatccaggcatcagtagaagaagaagaagaggtagaagaagaaggagatgaaggtgaagaagaagtagaggaagaaaaacagacgacgcaagcgagtggtgaagaagggaggctttacgttgggaatttaccttacacaatcacttcttctgagctctctcagatttttggagaagctggaactgtcgtcgatgttcagattgtttatgataaagttactgatagaagcagaggatttggatttgtaacaatgggaagcattgaagaagctaaagaagcgatgcagatgtttaacagctctcaaattggtggtagaacggtgaaagtgaacttcccggaggtgccgagaggcggtgagaacgaagtaatgagaaccaaaatccgtgataataaccggagttatgttgatagtcctcataaggtatatgcaggaaaccttggttggaatctaacctcacaaggtttaaaggatgcatttggtgatcaacctggtgtgcttggtgctaaagttatctatgaaagaaatactgggaggtctagggggtttggtttcatctcgttcgagtcagcggaaaatgttcagtctgctttggctacaatgaatggcgtggaagttgaaggacgagcgctgaggctaaatttggcttcagagagagagaaacccactgtgtctcctccttccgtagaagaaggagaaaccgaggaggccagtctagagagtaacgaggtgctttcgaatgttagtgcatgaagcagcaaaagcacaatagattccggataagtttcagactgatctgctcgaggtgccaaaaatgaaaattttgttgtctttataaatgtgttgttttgttctagtgaggctgaagaagaagacaatatatgagatagaaaacaagagattgtttgtaatttttattgagaatgtttttaatccataaatggtgtaatgtaacaacatatcttgattccagtaaactgcaaatttctgcc

SEQ ID NO: 163 - protein, 329 aa, Arabidopsis thaliana
  misc_feature (1)..(329): Ceres CLONE ID no. 14246
  misc_feature (1)..(329): Also Known As Ceres CDNA ID no. 23657254
  misc_feature (1)..(329): Also Known As Ceres GEMINI ID no. 532D11
  misc_feature (118)..(189): Pfam Name: RRM_1 Pfam Description: RNA recognition motif. ( a.k.a. RRM, RBD, or RNP domain)
MSSAYCSSAVAVSAAATASSAATFNPLLSSHSNSQLFYRFTPKSFKLVANCPNPLILHSNIRRHRFFCAAETEASSADDEIQASVEEEEEVEEEGDEGEEEVEEEKQTTQASGEEGRLYVGNLPYTITSSELSQIFGEAGTVVDVQIVYDKVTDRSRGFGFVTMGSIEEAKEAMQMFNSSQIGGRTVKVNFPEVPRGGENEVMRTKIRDNNRSYVDSPHKVYAGNLGWNLTSQGLKDAFGDQPGVLGAKVIYERNTGRSRGFGFISFESAENVQSALATMNGVEVEGRALRLNLASEREKPTVSPPSVEEGETEEASLESNEVLSNVSA

SEQ ID NO: 164 - protein, 314 aa, Glycine max
  misc_feature (1)..(314): Ceres CLONE ID no. 511197
  misc_feature (1)..(314): Functional Homolog of  Ceres CLONE ID no. 14246 at SEQ ID NO. 163 with e-value of 6.10E-77 and percent identity of 61.5
MAAVSSSICNRIYNLSFTHPSLSLTTCNFRQRPISQKPFTLNLKSQSFTLSFFPLHRLPPPSAAFDGFEVAQDTTEFQQDEPETEPVEKTEQEEEQKVSDSYDAGRLYVGNLPYSITNSALAELFGEAGTVASVEIMYDRVTDRSRGFAFVTMGNVEDAKEAIRMFDGSQVGGRTVKVNFPEVPKGGERLVMGSKIRNSYRGFVDSPHKIYAGNLGWGLTSQGLREAFAEQPGVLSAKVIYERDSGRSRGFGFVSFETAESAQAALDIMNGVEVQGRPLRLNLAEARAPSSPPVIQKNVGSNVESSELVSSAST

SEQ ID NO: 165 - protein, 319 aa, Nicotiana sylvestris
  misc_feature (1)..(319): Public GI No. 311952
  misc_feature (1)..(319): Functional Homolog of  Ceres CLONE ID no. 14246 at SEQ ID NO. 163 with e-value of 2.20E-79 and percent identity of 55.0
MSVAATASTCSTSSLYLFTQKPKFSVEHLSLSTYNAHFNFKINSTKLKAHFPISSLYRSSIFLSTCASVSDGVEVVQEDDEEEVALSAEEEEEIEEKEESVESESVEGGRLYVGNLPFSMTSSQLSEIFAEAGTVANVEIVYDRVTDRSRGFAFVTMGSVEEAKEAIRLFDGSQVGGRTVKVNFPEVPRGGEREVMSAKIRSTYQGFVDSPHKLYVANLSWALTSQGLRDAFADQPGFMSAKVIYDRSSGRSRGFGFITFSSAEAMKSALDTMNEVELEGRPLRLNVAGQKAPLSSPSVVETSPENDSENNELLSSLSS

SEQ ID NO: 166 - protein, 324 aa, Nicotiana tabacum
  misc_feature (1)..(324): Public GI No. 20005
  misc_feature (1)..(324): Functional Homolog of  Ceres CLONE ID no. 14246 at SEQ ID NO. 163 with e-value of 2.50E-78 and percent identity of 54.7
MSGCCFSFAATASTSSTSLLYLFTQKPKFSVDHLSLSTYNTHFNFKINSTKLKAHFPISSLYRSSIFLSTCASVSDGVEVVQEDDEEEVALSAEEEEEIEEKEERVESESVEGGRLYVGNLPFSMTSSQLSEIFAEAGTVANVEIVYDRVTDRSRGFAFVTMGSVEEAKEAIRLFDGSQVGGRTVKVNFPEVPRGGEREVMSAKIRSTYQGFVDSPHKLYVANLSWALTSQGLRDAFADQPGFMSAKVIYDRSSGRSRGFGFITFSSAEAMNSALDTMNEVELEGRPLRLNVAGQKAPVSSPPVVETSPENDSDNSELLSSLSS

SEQ ID NO: 167 - protein, 341 aa, Zea mays
  misc_feature (1)..(341): Ceres CLONE ID no. 1537388
  misc_feature (1)..(341): Functional Homolog of  Ceres CLONE ID no. 14246 at SEQ ID NO. 163 with e-value of 5.50E-60 and percent identity of 54.7
MATAAAAVAATFRTLIQHAAACGAPVPLPSVRFQSLQRHRVGLRRLAPPRGRPVLTPPFAAEDFSSYVDDFSGDDGEEHFDEEEGSEPEEEAEAPRAYSSPRSRPPRGDDPGRLFVGNLPYTYTSEELAQVFSEAGRVDDAQIIYDKVTNRSRGFAFVTMATAEEAAKAIQMFDGALLGGRTARVNYPEVPRGGERRTVTMSGRRRDDGTYKIYAGNLGWGVRADTLRNVFEGRAGLLDARVIFERETGRSRGFGFVSFSTAEDAQAALESLDGVELEGRPLRLSLAEQNPPPGSPPSTAQAQQEETDSGAPAGAGTEAASSSEPSEAEVGESNLQTAANY

SEQ ID NO: 168 - protein, 348 aa, Oryza sativa subsp. japonica
  misc_feature (1)..(348): Public GI No. 50934311
  misc_feature (1)..(348): Functional Homolog of  Ceres CLONE ID no. 14246 at SEQ ID NO. 163 with e-value of 7.49E-63 and percent identity of 56.0
MAAVAFRSLLHPAAAALTERVPLPPAHLRLQGLHRHRVGVLNLFVASGHRRRILLPLAAAGGEFSSEEEEYANEEEEEGEEYVEEEEEDGEEEEAAAVAAPRGYYPPRSRPALGQEPGRLFVGNLPYTMTSGEISQTFSEAGRVDNVQIIYDKVTDRSRGFAFVTMATAEEAATAIQMFNGALLGGRTARVNYPEVPRGGERAVGSAAATRENRRDDGTFKIYAGNLGWGVRADALRAAFEGQPGLLDARVIFERDSGRSRGFGFVSFRTAEDAQAALEALDGVELEGRPLRLSMAEQNPTAGSPSTVQSQEEETASESSDAETEQSITSEPSEAETEESNLQTAASY

SEQ ID NO: 169 - protein, 344 aa, Hordeum vulgare subsp. vulgare
  misc_feature (1)..(344): Public GI No. 3550485
  misc_feature (1)..(344): Functional Homolog of  Ceres CLONE ID no. 14246 at SEQ ID NO. 163 with e-value of 9.29E-65 and percent identity of 51.3
MATAVVAFRSFLHPTATAAAIPLPPSHFNLNNFQGHCIGLRLFSSHRSHPILLPASASAASGQEFSSDGEYYSEEYVEEEGEEAEPEVEAVRGYYPPRNRPALGQEPGRIYVGNLPYTFTAAELTAAFSEAGSVDDVQIIYDKITDRSRGFAFVTMATAEEAAKAVQMFNGALLGGRTVRVNFPEVPRGGERAVASAAVARTSLRVVDDGTYKVYAGNLGWGVRADALKTAFEGQPGLVGARVIFERDTGRSRGFGFVSFHTIQDAKAALQAMDGVELDGRPLRLSLAAQNPPAGSTPSTAQSQQEKTASRGSEAEPQVDNNTITSGQFGGEMEKSNLQATASY

SEQ ID NO: 170 - DNA, 1648 bp, Arabidopsis thaliana
  misc_feature (1)..(1648): Ceres CLONE ID no. 149496
  misc_feature (1)..(1648): Also Known As Ceres GEMINI ID no. 555B2
aattctctgtctgtgataaaagaaaaattgaatttttttcttctatctatctacctctgttcttcctcgtcatttcttacccagaaaaatagaggataacaaaaatctgtttctttcgatgatcatcgtgacactttctctgtgatttttcctttcttctgttgttgttgatcatcgtgatcatcgtctttccttacatgcgaacccccatgtcagacactcagcatgtacagagctctttggtgtcgattcgatcttccgacaaaatcgaagatgcctttaggaagatgaaagtaaatgagaccggcgtggaggaactgaatccgtatccagatcgtcccggtgaaagagattgccaattctatttaagaactggtctctgtggctatggaagcagttgccgttacaatcatcctactcatcttccacaggatgttgcttattacaaggaggagctccctgagagaattggacagccggattgtgagtattttctgaagacaggagcttgtaagtacggcccaacttgtaaatatcatcatccaaaggacaggaacggtgcacaacctgtaatgttcaatgttatcggtttacctatgcgtctgggtgagaagccatgtccatattacctgcgaacgggaacttgcagattcggagttgcttgcaaattccaccatcctcaacctgataatggacattctactgcatatggaatgtctagctttcctgctgcagatttacgatatgctagtggtttaacaatgatgtctacatatggaactttgcctcgtccgcaagttccccagtcctatgtgccaatcctggtttcaccctctcaaggctttttacctcctcaaggctgggccccttacatggctgcatctaactccatgtacaatgtgaagaatcaaccttattactccggtagtagtgcatccatggccatggctgtggcattgaaccgtggtttgtcagaaagttctgaccaaccagaatgtcggttttttatgaacaccgggacatgtaaatacggagacgattgcaaatacagccatcccggagtaaggatttcacaaccaccaccaagtcttataaaccctttagttcttccagcgagacctggacaaccagcttgtggtaacttcaggtcttatggattctgcaagtttggaccaaactgcaaattcgaccaccctatgctgccatatccgggcctgaccatggctacttctctgcctactccttttgcttcacctgttacaacccatcagaggatctcaccaacaccaaaccgctctgattcaaagtctctttctaatggtaaacctgatgtgaagaaagaaagctcagagactgagaaaccagacaatggagaagtgcaggatttgtctgaggatgcgtcatcaccatgatcatgattcttaaaaaccccaatgatctctctctgcccttttttgtggaagaggaggggaggtgaaaagtgtttctcttttctttttttttcttttttttttggcttggagatggccatggctgaaaacaatataggatgaaaccagtgatgttgtcacaggtttctcttctgtttttgactctgttaataaattttaatcagacttatcagaggaaaaatagagtttgtgttgtg

SEQ ID NO: 171 - protein, 404 aa, Arabidopsis thaliana
  misc_feature (1)..(404): Ceres CLONE ID no. 149496
  misc_feature (1)..(404): Also Known As Ceres GEMINI ID no. 555B2
  misc_feature (308)..(334): Pfam Name: zf-CCCH Pfam Description: Zinc finger C-x8-C-x5-C-x3-H type ( and similar)
MRTPMSDTQHVQSSLVSIRSSDKIEDAFRKMKVNETGVEELNPYPDRPGERDCQFYLRTGLCGYGSSCRYNHPTHLPQDVAYYKEELPERIGQPDCEYFLKTGACKYGPTCKYHHPKDRNGAQPVMFNVIGLPMRLGEKPCPYYLRTGTCRFGVACKFHHPQPDNGHSTAYGMSSFPAADLRYASGLTMMSTYGTLPRPQVPQSYVPILVSPSQGFLPPQGWAPYMAASNSMYNVKNQPYYSGSSASMAMAVALNRGLSESSDQPECRFFMNTGTCKYGDDCKYSHPGVRISQPPPSLINPLVLPARPGQPACGNFRSYGFCKFGPNCKFDHPMLPYPGLTMATSLPTPFASPVTTHQRISPTPNRSDSKSLSNGKPDVKKESSETEKPDNGEVQDLSEDASSP

SEQ ID NO: 172 - DNA, 1160 bp, Arabidopsis thaliana
  misc_feature (1)..(1160): Ceres CLONE ID no. 154718
  misc_feature (1)..(1160): Also Known As Ceres CDNA ID no. 23376572
  misc_feature (1)..(1160): Also Known As Ceres GEMINI ID no. 554B10
atcttttcttacaaagactttttgacatctccccctccagctattatatagtctccttttttcttttctgcattcacataatattgcccctatatagtttacacaacatcatacccaccaacatatataatcttgatcatagagagataaacagaggccgctatcaagaacaagactaagaacaagacttcactaggagtacaagtatgggaagagcaccgtgttgtgacaaagcaaacgtgaagaaagggccttggtctcctgaggaagatgcaaaactcaaatcttacattgaaaatagtggcaccggaggcaattggatcgctttgcctcaaaagattggtttaaagagatgtggaaagagttgcaggctgaggtggcttaactatcttagaccaaacatcaaacacggtggcttctctgaggaagaagaaaacatcatttgtagcctttaccttacaattggtagcaggtggtctataatcgctgctcaattgccgggacgaacagacaacgatataaaaaactattggaacacgaggctcaagaagaaactcattaacaaacaacgcaaggagcttcaagaagcttgtatggagcagcaagagatgatggtgatgatgaagagacaacaccaacaacaacaaatccaaacttcttttatgatgagacaagaccaaacaatgttcacatggccactacatcatcataatgttcaagttccagctcttttcatgaatcaaaccaactcgttttgcgaccaagaagatgttaagccagtgctcatcaagaacatggtcaagatcgaagatcaagaactggagaaaacaaaccctcatcatcatcaagattcaatgacaaacgcttttgatcatctctctttctctcaactcttgttagatcctaatcataaccacttaggatcaggagagggtttctccatgaactctatcttgagcgccaacacaaactctccattgcttaacacaagtaatgataatcagtggttcgggaatttccaggccgaaaccgtaaacttgttctcaggagcctccacaagtacttcggcagatcaaagcactataagttgggaagacataagctctcttgtttattctgattcaaagcaatttttttaattataataatatattattctt

SEQ ID NO: 173 - protein, 310 aa, Arabidopsis thaliana
  misc_feature (1)..(310): Ceres CLONE ID no. 154718
  misc_feature (1)..(310): Also Known As Ceres CDNA ID no. 23376572
  misc_feature (1)..(310): Also Known As Ceres GEMINI ID no. 554B10
  misc_feature (68)..(113): Pfam Name: Myb_DNA-binding Pfam Description: Myb-like DNA-binding domain
MGRAPCCDKANVKKGPWSPEEDAKLKSYIENSGTGGNWIALPQKIGLKRCGKSCRLRWLNYLRPNIKHGGFSEEEENIICSLYLTIGSRWSIIAAQLPGRTDNDIKNYWNTRLKKKLINKQRKELQEACMEQQEMMVMMKRQHQQQQIQTSFMMRQDQTMFTWPLHHHNVQVPALFMNQTNSFCDQEDVKPVLIKNMVKIEDQELEKTNPHHHQDSMTNAFDHLSFSQLLLDPNHNHLGSGEGFSMNSILSANTNSPLLNTSNDNQWFGNFQAETVNLFSGASTSTSADQSTISWEDISSLVYSDSKQFF

SEQ ID NO: 174 - protein, 310 aa, Arabidopsis thaliana
  misc_feature (1)..(310): Public GI No. 2832408
  misc_feature (1)..(310): Functional Homolog of  Ceres CLONE ID no. 154718 at SEQ ID NO. 173 with e-value of 0.0 and percent identity of 88.5
MGRAPCCDKANVKKGPWSPEEDAKLKSYIENSGTGGNWIALPQKIGLKRCGKSCRLRWLNYLRPNIKHGGFSEEEENIICSLYLTIGSRWSIIAAQLPGRTDNDIKNYWNTRLKKKLINKQRKELQEACMEQQEMMVMMKRQHQQQQIQTSFMMRQDQTMFTWPLHHHNVQVPALFRIKPTRFATKKMLSQCSSRTWSRSKIKNWRKQTSSSSRFNDNAFDHLSFSQLLLDPNHNHLGSGEGFSMNSILSANTNSPLLNTSNDNQWFGNFQAETVNLFSGASTSTSADQSTISWEDISSLLVYSDSKQFF

SEQ ID NO: 175 - protein, 321 aa, Oryza sativa subsp. japonica
  misc_feature (1)..(321): Public GI No. 50872446
  misc_feature (1)..(321): Functional Homolog of  Ceres CLONE ID no. 154718 at SEQ ID NO. 173 with e-value of 3.69E-61 and percent identity of 72.0
MGRAPCCDKASVKKGPWSPEEDAKLKSYIEQNGTGGNWIALPQKIGLKRCGKSCRLRWLNYLRPNIKHGGFSEEEDRIILSLYISIGSRWSIIAAQLPGRTDNDIKNYWNTRLKKKLFGKQSRKDQRQQQHLARQAAAAASDLQIKQEASRGANEADGLAAGANYTWHHHHAMAVPVHPMSAPMVVEGGRVGDDVDESIRKLLFKLGGNPFAASPAPPCIPPPPMYEEAPSFVPPLAHGVPLNEGGMQCSSVLPALELDENFHFNHVKLDGLECLFGMGDHQNMRWNEVSPLVCPNNAVASSSQGMQQYCLVEEPADLGMQ

SEQ ID NO: 176 - DNA, 1679 bp, Arabidopsis thaliana
  misc_feature (1)..(1679): Ceres CLONE ID no. 158155
  misc_feature (1)..(1679): Also Known As Ceres CDNA ID no. 23514168
  misc_feature (1)..(1679): Also Known As Ceres GEMINI ID no. 554G10
accttttaagaccaaatctctctctacctctatctctctctccgccattaccagagctcaacgagctctcactttctttacgcacacttgttggaacgaaatatattcatagagaagaagaatctcgaaactcttgaatctaaaacaactcggagactctgttttccctttccggagatcagatcggatcaagatgcagacaaccaacggctcagattcgacgttggcaacttccggagccacaccgccgaatcaacaaacccctcctccacctcagcagtggcagcagcagcaacagcaacagcaacagtggatggctgccatgcaatatccaccagcggcggcgatgatgatgatgcagcagcaacagatgctgatgtatcctcatcaatatgttccgtataatcaaggtccttatcagcagcatcatcctcagcttcaccaatacgggtcttatcaacagcaccagcaccagcaacacaaggctattgaccgtggatctggagatgatgtcaagactctttgggttggtgatcttcttcattggatggatgagacttatctccattcttgcttttctcacaccggcgaggtttcttctgtgaaagttatacgtaacaagctcacttctcaatcagaagggtatgggtttgttgagtttctttcacgtgctgcagctgaagaagttcttcagaactatagtggttcagtgatgccaaactcggaccaacccttccgtataaactgggcatcttttagtactggtgaaaaaagagcagtggaaaatggtccagacctatctgtttttgtgggagacttgtctccagatgtcactgacgttttattgcatgagaccttttctgatagatatccttctgtcaaaagcgccaaagttgtgattgattccaacaccggccggtccaaaggttatggttttgtgaggttcggtgatgaaaatgagaggtcaagggctttgacagaaatgaatggagcttactgttcgaacaggcaaatgcgtgtaggtattgcaactcccaaaagagcgattgctaatcagcaacaacattcttcacaagctgtgattctggctggtggacatggatcaaatggttccatgggttatggctcgcagtctgatggcgaatcaactaacgcaacaatatttgttggcggcattgaccctgatgttattgatgaagacctcagacaacctttttcccagtttggagaggttgtttcagtgaagatcccagtagggaaaggatgtggatttgtccaatttgctgacaggaagagtgctgaagatgctatcgagagtttgaacgggacagtcatcggcaagaacactgtcagactctcctggggacgaagcccaaacaagcagtggagaggagactcagggcagcagtggaatggaggatactcacgaggacatggttacaacaatggaggaggatatgctaaccaccacgactccaacaactatcatggggagaattgaagagactcatcaagtgatcatcttcatcatggtttcacatatcaaagctaaaacctgtagtcgaaagaagaattttgttagatggatttgattttgatagacttgttgtttggaggagattcaaaaattttggttactggtttgtctcagactaatataaatggttgcaacttgttgg

SEQ ID NO: 177 - protein, 435 aa, Arabidopsis thaliana
  misc_feature (1)..(435): Ceres CLONE ID no. 158155
  misc_feature (1)..(435): Also Known As Ceres CDNA ID no. 23514168
  misc_feature (1)..(435): Also Known As Ceres GEMINI ID no. 554G10
  misc_feature (204)..(276): Pfam Name: RRM_1 Pfam Description: RNA recognition motif. ( a.k.a. RRM, RBD, or RNP domain)
  misc_feature (323)..(388): Pfam Name: RRM_1 Pfam Description: RNA recognition motif. ( a.k.a. RRM, RBD, or RNP domain)
MQTTNGSDSTLATSGATPPNQQTPPPPQQWQQQQQQQQQWMAAMQYPPAAAMMMMQQQQMLMYPHQYVPYNQGPYQQHHPQLHQYGSYQQHQHQQHKAIDRGSGDDVKTLWVGDLLHWMDETYLHSCFSHTGEVSSVKVIRNKLTSQSEGYGFVEFLSRAAAEEVLQNYSGSVMPNSDQPFRINWASFSTGEKRAVENGPDLSVFVGDLSPDVTDVLLHETFSDRYPSVKSAKVVIDSNTGRSKGYGFVRFGDENERSRALTEMNGAYCSNRQMRVGIATPKRAIANQQQHSSQAVILAGGHGSNGSMGYGSQSDGESTNATIFVGGIDPDVIDEDLRQPFSQFGEVVSVKIPVGKGCGFVQFADRKSAEDAIESLNGTVIGKNTVRLSWGRSPNKQWRGDSGQQWNGGYSRGHGYNNGGGYANHHDSNNYHGEN

SEQ ID NO: 178 - protein, 445 aa, Arabidopsis thaliana
  misc_feature (1)..(445): Ceres CLONE ID no. 1361871
  misc_feature (1)..(445): Functional Homolog of  Ceres CLONE ID no. 158155 at SEQ ID NO. 177 with e-value of 0.0 and percent identity of 80.7
MQTPNNNGSTDSVLPPTSAGTTPPPPLQQSTPPPQQQQQQQWQQQQQWMAAMQQYPAAAMAMMQQQQMMMYPHPQYAPYNQAAYQQHPQFQYAAYQQQQQQHHQSQQQPRGGSGGDDVKTLWVGDLLHWMDETYLHTCFSHTNEVSSVKVIRNKQTCQSEGYGFVEFLSRSAAEEALQSFSGVTMPNAEQPFRLNWASFSTGEKRASENGPDLSIFVGDLAPDVSDAVLLETFAGRYPSVKGAKVVIDSNTGRSKGYGFVRFGDENERSRAMTEMNGAFCSSRQMRVGIATPKRAAAYGQQNGSQALTLAGGHGGNGSMSDGESNNSTIFVGGLDADVTEEDLMQPFSDFGEVVSVKIPVGKGCGFVQFANRQSAEEAIGNLNGTVIGKNTVRLSWGRSPNKQWRSDSGNQWNGGYSRGQGYNNGYANQDSNMYATAAAAVPGAS

SEQ ID NO: 179 - protein, 431 aa, Glycine max
  misc_feature (1)..(431): Ceres CLONE ID no. 621732
  misc_feature (1)..(431): Functional Homolog of  Ceres CLONE ID no. 158155 at SEQ ID NO. 177 with e-value of 0.0 and percent identity of 67.8
MAQPSSNGDLNNNQQQGQVQQQQQQGQWAAAAQPHQYQQQWMAMQYPATAMAMMQQQMLMYPQHYMPYAHPHYPPPPPPPPSSHHHHHHKQAAASSDEIRTVWLGDLHHWMDENYLHNCFAHTGEVVSAKVIRNKQTGQSEGYGFVEFYSRGTAEKVLQNYNGTMMPNTDQAFRLNWATFSAGERRSSDATSDLSIFVGDLAIDVTDAMLQDTFAGRYSSIKGAKVVIDSNTGRSKGYGFVRFGDENERTRAMTEMNGVYCSSRPMRIGVATPKKTYGFQQQYSSQAVVLAGGHSANGAVAQGSHSEGDINNTTIFVGGLDSDTSDEDLRQPFLQFGEVVSVKIPVGKGCGFVQFADRKNAEEAIQGLNGTVIGKQTVRLSWGRSPGNKHWRSDSNGGHYGGHQGYGGHGFAVRQNQDIAMQPAAAIQGAS

SEQ ID NO: 180 - protein, 428 aa, Lycopersicon esculentum
  misc_feature (1)..(428): Public GI No. 40804404
  misc_feature (1)..(428): Functional Homolog of  Ceres CLONE ID no. 158155 at SEQ ID NO. 177 with e-value of 9.99E-130 and percent identity of 68.9
MNGDMNQQQQQQQLQQQQQQQWMAMQQYQQQWMAMQQYPPAAAMVMQQQMMYGQQYMPYYHQQHQQMIQIQQNASEDNRTIWIGDLQQWMDEGYLHTCFAQAGEVISVKVIRNKQTGQSERYGFIEFNTHEAAEKVLQSYNGTMMPNAEQPFRLNWSAFSSGEKRADVGAGAGSGSDLSIFVGDLASDVTDTMLRDTFSSRYPSVKGAKVVIDSNTGRSKGYGFVRFDDESERSRAMTEMNGIYCSSRAMRIGVATPKKPSPMQQYFPQAVILAGGHASNGAATQTSQTDSDLSNTTVFVGGLDSEVTDEELRQSFSQFGNVVSVKIPAGKGCGFVQFSERSAAEDAIEKLNGTVIGAQTVRLSWGRNPANKQFRTDSGSQWNGGYYGRQNYGGYGYGASQSQDSMYGAGAAHGASSNGYGNHEQSVS

SEQ ID NO: 181 - protein, 428 aa, Nicotiana plumbaginifolia
  misc_feature (1)..(428): Public GI No. 9663769
  misc_feature (1)..(428): Functional Homolog of  Ceres CLONE ID no. 158155 at SEQ ID NO. 177 with e-value of 0.0 and percent identity of 67.2
MNGGDMNQQQQQQQQQHQQQQQQWLAMQQYQQQWMAMQYPAAAMAMQQQMMYGQQYMPYYQQHQQQQKMQQSPTQIQSSSEDNKTIWIGDLQQWMDESYLHSCFSQAGEVISVKIIRNKQTGQSERYGFVEFNTHAAAEKVLQSYNGTMMPNTEQPFRLNWAGFSTGEKRAETGSDFSIFVGDLASDVTDTMLRDTFASRYPSLKGAKVVVDANTGHSKGYGFVRFGDESERSRAMTEMNGVYCSSRAMRIGVATPKKPSAHEQYSSQAVILSGGYASNGAATHGSQSDGDSSNTTIFVGGLDSEVTDEELRQSFNQFGEVVSVKIPAGKGCGFVQFSDRSSAQEAIQKLSGAIIGKQAVRLSWGRSPANKQMRTDSGSQWNGGYNGRQNYGGYGYGASQNQDSGMYATGAAYGASSNRYGNHQQPVS

SEQ ID NO: 182 - DNA, 640 bp, Arabidopsis thaliana
  misc_feature (1)..(640): Ceres CLONE ID no. 16204
  misc_feature (1)..(640): Also Known As Ceres GEMINI ID no. 531H7
aatcgtcgtctctccccaattcaaaaaaagaaataacctaaacgtgttcacacagagatctcgagatgaaagataaccaaacggaagttgaatcgaggagcactgatgatagattgaaagttagagggaacaaagttggaaagaaaacaaaggatccaaacaggcctaagaaaccaccaagtcctttcttcgtcttcctggacgatttccgaaaggagtttaatctggctaaccctgacaacaaatccgtcggtaatgttggtagagcagctggaaagaaatggaaaaccatgactgaggaagaaagagcaccttttgtagcaaaatcacagagcaaaaagactgagtatgctgtgactatgcaacagtataacatggaactggctaatggaaacaagacaactggagatgatgagaaacaagagaaagctgctgatgattaggaagttggatcagtgatttgtgtatcaactatatctgttgttttatgtcaacttttagctagcttttagggagaacaattgttacattcctgttttatcctttctgtcaactgtgggattattcagatgtaactttggatttagctttgagcttcaattccaccttttatgagatcatatcatatgtttgcaatctt

SEQ ID NO: 183 - protein, 125 aa, Arabidopsis thaliana
  misc_feature (1)..(125): Ceres CLONE ID no. 16204
  misc_feature (1)..(125): Also Known As Ceres GEMINI ID no. 531H7
  misc_feature (34)..(103): Pfam Name: HMG_box Pfam Description: HMG (high mobility group) box
MKDNQTEVESRSTDDRLKVRGNKVGKKTKDPNRPKKPPSPFFVFLDDFRKEFNLANPDNKSVGNVGRAAGKKWKTMTEEERAPFVAKSQSKKTEYAVTMQQYNMELANGNKTTGDDEKQEKAADD

SEQ ID NO: 184 - protein, 881 aa, Arabidopsis thaliana
  misc_feature (1)..(881): Ceres CLONE ID no. 98140
  misc_feature (1)..(881): Also Known As Ceres CDNA ID no. 23448005
  misc_feature (1)..(881): Also Known As Ceres GEMINI ID no. 531C1
  misc_feature (1)..(881): Functional Homolog of  Ceres CLONE ID no. 16204 at SEQ ID NO. 183 with e-value of 1.09E-18 and percent identity of 46.0
AGGCCTCATCTCTTACTCTCTCTCTCTGATCGTCTTTTTCTTTTGATTCTGCTTTTTTCTGCTAGGTTTCTGAGATCTTCCATTCGTCTCGAATTAAGTTGCTACGATGAAGACAGCGAAGGGGAAAGATAAAGTTAAGACCACAAAGGAAGCCTTGAAGCCAGTTGATGACAGAAAGGTGGGAAAGAGGAAGGCACCGGCCGAGAAGCCTACTAAACGAGAGACTCGTAAAGAAAAGAAGGCTAAAAAGGACCCAAACAAACCAAAAAGAGCTCCTAGTGCCTTCTTTGTCTTTCTAGAAGATTTTAGGGTCACGTTCAAGAAAGAAAATCCAAATGTGAAGGCCGTCTCTGCTGTTGGGAAAGCTGGAGGGCAGAAATGGAAGGCAATGTCTCAAGCTGAAAAAGCTCCATATGAAGAGAAAGCTGCAAAAAGGAAAGCTGAATATGAGAAGCAAATGGATGCATACAACAAAAACTTGGAGGAAGGGAGTGATGAATCTGAAAAGTCTAGATCTGAGATAAATGATGAAGATGAAGCCAGTGGGGAGGAAGAACTACTAGAGAAGGAAGCGGCAGGTGATGATGAAGAAGAAGAAGAGGAAGAAGATGACGATAATGATGACGACGAGGAAGAAGACTAAATCAGGGATAGAAATCAGATTTTGTATCTCAAGCTTAACTGCAGATCCTTAAGCAGAAGTAAGTATTTTGTAATTTGTGTGTCGACGAGAACTATAGATCTAAAATCGTGTGTATTTTTGTTTTTCTTTTCCTAAGAAAGCGAAACAGTTGTTAGCATCTCTCAGGATGTCTGTTTCAGCTTTTTGCCGCAACAAACAATGTATCAATGTCTGCGTTAGTGATCATCCAAACCAAAAC

SEQ ID NO: 185 - protein, 178 aa, Arabidopsis thaliana
  misc_feature (1)..(178): Ceres CLONE ID no. 98140
  misc_feature (1)..(178): Also Known As Ceres CDNA ID no. 23448005
  misc_feature (1)..(178): Also Known As Ceres GEMINI ID no. 531C1
  misc_feature (1)..(178): Functional Homolog of  Ceres CLONE ID no. 16204 at SEQ ID NO. 183 with e-value of 1.09E-18 and percent identity of 46.0
MKTAKGKDKVKTTKEALKPVDDRKVGKRKAPAEKPTKRETRKEKKAKKDPNKPKRAPSAFFVFLEDFRVTFKKENPNVKAVSAVGKAGGQKWKAMSQAEKAPYEEKAAKRKAEYEKQMDAYNKNLEEGSDESEKSRSEINDEDEASGEEELLEKEAAGDDEEEEEEEDDDNDDDEEED

SEQ ID NO: 186 - protein, 178 aa, Arabidopsis thaliana
  misc_feature (1)..(178): Public GI No. 21360557
  misc_feature (1)..(178): Functional Homolog of  Ceres CLONE ID no. 16204 at SEQ ID NO. 183 with e-value of 8.30E-19 and percent identity of 46.0
MKTAKGKDKVKTTKEALKPVDDRKVGKRKAPAEKPTKRETRKEKKAKKDPNKPKRAPSAFFVFLEDFRVTFKKENPNVKAVSAVGKAGGQKWKSMSQAEKAPYEEKAAKRKAEYEKQMDAYNKNLEEGSDESEKSRSEINDEDEASGEEELLEKEAAGDDEEEEEEEDDDDDDDEEED

SEQ ID NO: 187 - protein, 169 aa, Glycine max
  misc_feature (1)..(169): Ceres CLONE ID no. 480916
  misc_feature (1)..(169): Functional Homolog of  Ceres CLONE ID no. 16204 at SEQ ID NO. 183 with e-value of 5.09E-19 and percent identity of 45.1
MKTAKGKGAARPSKESLKPVDDRKVGKRKASGKPEKSRAPKKEKKAKKDPNKPKRPPSAFFVFLEEFRKTFKAENPLVKAVSVVGKAGGEKWKSLSSAEKAPYEAKAAKRKAEYEKLIKAYEKKQASSADDDESDKSKSEVNDEDDASGEEDHQEDEDDEEEEDDEDDD

SEQ ID NO: 188 - protein, 146 aa, Glycine max
  misc_feature (1)..(146): Ceres CLONE ID no. 1043468
  misc_feature (1)..(146): Functional Homolog of  Ceres CLONE ID no. 16204 at SEQ ID NO. 183 with e-value of 2.80E-11 and percent identity of 37.7
  misc_feature (119)..(119): Xaa is any aa, unknown, or other
MTERLESGRLPVSLGEVVHQRRRRRPRKTPTSLKDHPVLSLCSLEEFRKTFKAENPNVKAVSVVGKAGGEKWKSLSSAEKAPYEAKAAKRKAEYEKLIKAYDKKQASSADDEESDKSKXEVNDEDDASGEEEEEDDEEEEDDEDDD

SEQ ID NO: 189 - DNA, 1435 bp, Arabidopsis thaliana
  misc_feature (1)..(1435): Ceres CLONE ID no. 16209
  misc_feature (1)..(1435): Also Known As Ceres GEMINI ID no. 555E9
acgcaaacatatccattagggtcacaacggttcttacagcttctattaccagaaaggaaagaaagccgaaatttgtttcaagataaagtaatttaagttggagcttgtttcttggtcgtacagtgtcaggtgaatagagaagaagaagatggaaaacacagacgagcttgtctccattgagctaccagctccagcttcatggaagaaactgttttatccgaaaagagccggtactccgagaaagacggagattgtgtttgtggctccaacgggtgaagagattagctcgcggaagcagttggagcagtacctgaaggcccatcctggcaatcctgtcatctctgagtttgagtggacaactggggaaactccaaggaggtcttcaaggatcagccaaaaggtaaggctacaacgcctactcctgacaaagagcccctcctgaagaagagacgatcttctctcacgaagaaggacaataaggaggctgctgagaaaaatgaagaggctgctgtgaaggagaacatggatgttgataaggatgggaagacggaaaacgcagaggctgagaaggagaaagagaaggagggagtgacagaaattgcagaggcggagaaggagaacaacgagggtgagaagactgaggctgagaaggtgaacaaagagggtgagaaaactgaggctgggaaggagggtcaaacggaaattgcagaggctgagaaggagaaggagggtgaaaaggctgaggctgagaacaaagaggcagaagttgtgagagacaagaaagagtccatggaagtggatacctctgagttggagaagaaggctgggagtggagaaggagctgaagaaccttccaaagttgaaggcctcaaggacactgaaatgaaagaggcgcaggaagttgttactgaggctgatgtagagaagaagcctgcagaggaaaagactgagaacaagggcagcgtgacaaccgaagctaacggagaacagaatgtaaccctgggtgagcctaaccttgatgcagatgctgaagcagataagggaaaagaatccaaagaatatgatgagaagacgacagaagctgaggcgaataaggaaaatgacactcaagaatctgatgagaagaagacagaagctgcagcaaataaggagaacgaaacccaagagtctgatgtcaagaagaccgaagctgcagtagcagaggagaagagtaacgacatgaaggcagaagacacaaacagaagcttggaggcgaatcaagttcaacagcagcagggagctgcagcttccgtgagctgttaaaacctatatcgttctgtacagagcacagagcgtgaagagtttgttgtgatttcaggtgtagcattaacattatgagtggttgttgtatgtgttggtagaactaatgtctctctatgttgtagttcagtccatt

SEQ ID NO: 190 - protein, 259 aa, Arabidopsis thaliana
  misc_feature (1)..(259): Ceres CLONE ID no. 16209
  misc_feature (1)..(259): Also Known As Ceres GEMINI ID no. 555E9
MDVDKDGKTENAEAEKEKEKEGVTEIAEAEKENNEGEKTEAEKVNKEGEKTEAGKEGQTEIAEAEKEKEGEKAEAENKEAEVVRDKKESMEVDTSELEKKAGSGEGAEEPSKVEGLKDTEMKEAQEVVTEADVEKKPAEEKTENKGSVTTEANGEQNVTLGEPNLDADAEADKGKESKEYDEKTTEAEANKENDTQESDEKKTEAAANKENETQESDVKKTEAAVAEEKSNDMKAEDTNRSLEANQVQQQQGAAASVSC

SEQ ID NO: 191 - DNA, 1266 bp, Arabidopsis thaliana
  misc_feature (1)..(1266): Ceres CLONE ID no. 17632
  misc_feature (1)..(1266): Also Known As Ceres CDNA ID no. 23374596
  misc_feature (1)..(1266): Also Known As Ceres GEMINI ID no. 535H8
aaaatctcatctttttccctcgacgacaaccaccttagggttaggtttattttctcgcttattctctctaactctttttccctattccgatttcgatttgtcttctccgattcgcttttcctttcgctctctagactctagagtcaatttgatttctactctcgtatcggatctatacttaatcatggatactcgtaagagaggacggcctgaagctggctcattcaactccaatggcggcggatacaagaagtctaagcaagagatggaatcatattcaactggtttaggaagcaaatcgaagccatgcacaaaatttttcagtacttctggctgtcctttcggagagaattgccatttcttgcattatgttcccggaggatacaatgctgtatcgcagatgacaaatatgggaccacccattcctcaagtttccagaaacatgcaaggttctggtaatggaggccgattctcagggaggggagagtctgggcctggccatgtctctaactttggtgactcagccactgccagattcagtgttgatgcctctttagccggtgcaatcattgggaaaggcggagtcagttcaaagcagatatgtcgtcagacgggagtaaaattatcaattcaagatcacgagagagacccaaacttgaagaacattgtgcttgaaggaacacttgagcagataagcgaagcgagtgcaatggtaaaagatttgattgggaggcttaattcagcagctaagaaaccacctggtggtggtcttggtggtggtggtggcatgggttctgaagggaaaccacatccagggagcaacttcaagactaagatatgtgagagattctcaaaaggaaactgtacatttggtgatagatgtcactttgctcatggggaagcagagctacgcaagtcaggaatcgtctagttgttgcttgcagatagagaatttgctggtaaaactagtttcttatttagtggtggtgatatctgatatcatcttcacctactttgtttttgtttgttatgagagaatacaattttagtttcattatcattgtaagtctatttggtgtttttttttaatagctttagtttttggttaattctgagtatgaattgagatgggaggaagcttgaagagaatgattgacaaaactcagaaacagtggttaggattgtatgacgccttttattcatattcttgttatctccgttatgtcatgtgtgtgaatcacttatataattttcgtaagattttcc

SEQ ID NO: 192 - protein, 248 aa, Arabidopsis thaliana
  misc_feature (1)..(248): Ceres CLONE ID no. 17632
  misc_feature (1)..(248): Also Known As Ceres CDNA ID no. 23374596
  misc_feature (1)..(248): Also Known As Ceres GEMINI ID no. 535H8
  misc_feature (115)..(177): Pfam Name: KH_1 Pfam Description: KH domain
  misc_feature (37)..(63): Pfam Name: zf-CCCH Pfam Description: Zinc finger C-x8-C-x5-C-x3-H type ( and similar)
MDTRKRGRPEAGSFNSNGGGYKKSKQEMESYSTGLGSKSKPCTKFFSTSGCPFGENCHFLHYVPGGYNAVSQMTNMGPPIPQVSRNMQGSGNGGRFSGRGESGPGHVSNFGDSATARFSVDASLAGAIIGKGGVSSKQICRQTGVKLSIQDHERDPNLKNIVLEGTLEQISEASAMVKDLIGRLNSAAKKPPGGGLGGGGGMGSEGKPHPGSNFKTKICERFSKGNCTFGDRCHFAHGEAELRKSGIV

SEQ ID NO: 193 - protein, 231 aa, Arabidopsis thaliana
  misc_feature (1)..(231): Public GI No. 9294110
  misc_feature (1)..(231): Functional Homolog of  Ceres CLONE ID no. 17632 at SEQ ID NO. 192 with e-value of 9.39E-120 and percent identity of 98.2
MAADTRSLSKMESYSTGLGSKSKPCTKFFSTSGCPFGENCHFLHYVPGGYNAVSQMTNMGPPIPQVSRNMQGSGNGGRFSGRGESGPGHVSNFGDSATARFSVDASLAGAIIGKGGVSSKQICRQTGVKLSIQDHERDPNLKNIVLEGTLEQISEASAMVKDLIGRLNSAAKKPPGGGLGGGGGMGSEGKPHPGSNFKTKICERFSKGNCTFGDRCHFAHGEAELRKSGIV

SEQ ID NO: 194 - protein, 252 aa, Brassica napus
  misc_feature (1)..(252): Ceres CLONE ID no. 975540
  misc_feature (1)..(252): Functional Homolog of  Ceres CLONE ID no. 17632 at SEQ ID NO. 192 with e-value of 8.59E-110 and percent identity of 87.6
  misc_feature (195)..(195): Xaa is any aa, unknown, or other
MDTRKRAGSFNSNGGGGGGGSKKSKQEMESYSTGLGSKSKPCTKFFSTSGCPFGDNCHFLHYVPGGYNAVAQLTNMALPMPQASRNMQGPGGGGGGRFSGRGGESGPGHVSSFGASATAKISVDASLAGAIIGKGGVSSKQICRQTGAKLSIQDHERDPNLKNIELEGTFEQINEASVMVRELIGRLNSAASRRXPGGGGGIGGGVGSEGKPHPGSNFKTKMCERFAKGNCTFGDRCHFAHGEAELRRSGIA

SEQ ID NO: 195 - protein, 295 aa, Glycine max
  misc_feature (1)..(295): Ceres CLONE ID no. 473410
  misc_feature (1)..(295): Functional Homolog of  Ceres CLONE ID no. 17632 at SEQ ID NO. 192 with e-value of 4.80E-68 and percent identity of 71.1
MDIRKRGRPEPGFSLNGGFKKSKQEMESLSTGVGSKSKPCTKFFSTAGCPFGEGCHFLHYVPGGYNAVAHMMNLTPAAPLPPTRNVAALPHVPNGSAPSAVKTRICNKFNTAEGCKFGDKCHFAHGEWELGKHIAPSFDDHRAMGPPGAGRLAGRMEPPGPAASFGANSTAKISVEASLAGAIIGKGGVNSKQICRQTGAKLSIREHESDPNLRNIELEGSFEQIKEASNMVKDLLLTLQMSAPPKTTPGVPGAPASHGSNFKTKLCENFAKGSCTFGDRCHFAHGASELRKSGV

SEQ ID NO: 196 - protein, 299 aa, Triticum aestivum
  misc_feature (1)..(299): Ceres CLONE ID no. 703717
  misc_feature (1)..(299): Functional Homolog of  Ceres CLONE ID no. 17632 at SEQ ID NO. 192 with e-value of 6.50E-57 and percent identity of 65.5
MDAGRKRAVPEGANGGAAVKRARESESVQTGVGSKSKPCTKFFSTAGCPFGSSCHFLHNFPGGHQAVSKMTNLGGPAVSAPQGRMPMGPGVPDGPPTPSLKTRLCNKFNTAEGCKWGNKCHFAHGERELGKPMLLNNSMAPPMGPRPNGHFQPPPMPGPDMVPPSTFGASATAKISVDASLAGAIIGKGGVNTKHISRMTGAKLAIRDNEADPNHKNIELEGSFDQVNHASAMVKELILRIGGNAPPQAKNPGRGPAGGGGGSNFKTKLCDNFNKGSCTFGDRCHFAHGESELRKSAAA

SEQ ID NO: 197 - protein, 306 aa, Zea mays
  misc_feature (1)..(306): Ceres CLONE ID no. 1459706
  misc_feature (1)..(306): Functional Homolog of  Ceres CLONE ID no. 17632 at SEQ ID NO. 192 with e-value of 2.80E-56 and percent identity of 62.0
MDAAARKRSRPESANGGAAGGKRSRESESQQTGLSSKSKPCTKFFSTVGCPFGEGCHFAHFVPGGYQAVSKSHSLGHAAVSAPSRAPADHAASGVKTRMCTKYNTAEGCKFGDKCHFAHGERELGRPPSSYMSQESSYAPPMGGRYGGRHEPPLPASMGPPAGNFGASSTCKVSVDAALAGGIIGKGGVNTKQICRITGVKLSIRDHESNPDLKNIELEGSFDQIKQANDMVRDLIASISASTPSKNPASAAAPAGRGGGGGGGGPGGRSNYKTKICENFLKGTCTFGERCHFAHGETEQRKGAAV

SEQ ID NO: 198 - protein, 300 aa, Oryza sativa subsp. japonica
  misc_feature (1)..(300): Public GI No. 50905911
  misc_feature (1)..(300): Functional Homolog of  Ceres CLONE ID no. 17632 at SEQ ID NO. 192 with e-value of 1.90E-59 and percent identity of 66.6
MEVGGRKRGKPDGANGAGGKRARESESFQTGVGSKSKPCTKFFSTSGCPFGEGCHFLHHFPGGYQAVAKMTNLGGPAIAPPPGRMPMGNAVPDGPPTPTVKTRLCNKYNTAEGCKWGDKCHFAHGERELGKPMLMDSSMPPPMGPRPTGHFAPPPMPSPAMSTPASFGASATAKISVDASLAGGIIGRGGVNTKQISRVTGAKLAIRDHESDTNLKNIELEGTFDQIKNASAMVRELIVSIGGGAPPQGKKPVGGSHRGGGPGSNFKTKLCENFTKGSCTFGDRCHFAHGENELRKSAAA

SEQ ID NO: 199 - DNA, 1569 bp, Arabidopsis thaliana
  misc_feature (1)..(1569): Ceres CLONE ID no. 19340
  misc_feature (1)..(1569): Also Known As Ceres CDNA ID no. 23358277
  misc_feature (1)..(1569): Also Known As Ceres GEMINI ID no. 552A11
gattgactaaaagtcattaaattacaaatctaaagttaaaagtgtttcgtctgaaatttcttgttagctccaaaagaggaaaacgaatccaagaaggagaaaaagtctcattcctcaagctccgcatcattcctccttcatggggtctctgcatcttacaatttagcactctcatattattattccttaaaccccttgttttgattttgtttccagatttaaagaaaccctaagacctcttcgaaatttccccagaaacacttatttcatttcttccttggccttgactacgcgtctttccttttactccggaaggaagatccagaaaggttttctttcgatcgttgcttttgactatgcatagatctggtacaacaatggcgtggaacgtattcaagttctgtactgccttacgaggtcttggatcgatcatgatccttttggttcttggtgttgtcggtgttacttattacgctgtcgttttgactaattatggtcctccactctctcaaggtggccttgattctcttgctgctctcactatcttaatcctcttccatttcctcctggcaatgcttttgtggagctatttctcagtggtttttactgatcctggtgttgtgcctcctaattggagaccatctactgatgaagaaagaggtgaatctgatccgttaaatagtttggactttgttggtttacaatccgattcttcttcttcaaacccaagagttcggttttgtcggaagtgcaatcaactaaaaccttctcgttgtcatcattgttctgtttgtggtcggtgtgtgttgaagatggatcaccattgtgtttgggttgttaactgtgtaggagcactgaactataagtattttcttcttttcttgttctacacatttttagagacgacccttgtgactttggttcttatgccgcacttcattgcattctttagtgatgaagaaatacctggaaccccaggcactcttgctactacttttcttgcatttgttttgaacttggcatttgcgttgagcgtgatgggtttcttaattatgcatatttccttggtagctggcaataccacaactatagaggcatatgagaagaaaaccactacaaaatggcggtatgacctcggtaaaaagaaaaactttgaacaggtatttggaatggataagagatactggttaatcccaggatacacagaagaagatctaaggcgaatgccggagctgcagggacttgaatacccttcgaaaccagactttgattcccagtgatgctcaagaagactttgatcatcatcatcatcccatgtaaaacagcaatacgtagaaaaacagagcaagtggcatgtcaaggagaaatctactaacatgaagatggatgcttcactttaggcagtgtagatgtcttcccatggaaggctaagtcatcatcaaatttgtgggttttgaaaagaggatgattacaatttagctttgttggccacatatatgttcatcatcttcaatagttcatatatagatatgatcttattataaatgtagaacacacatgatttgccct

SEQ ID NO: 200 - protein, 307 aa, Arabidopsis thaliana
  misc_feature (1)..(307): Ceres CLONE ID no. 19340
  misc_feature (1)..(307): Also Known As Ceres CDNA ID no. 23358277
  misc_feature (1)..(307): Also Known As Ceres GEMINI ID no. 552A11
  misc_feature (118)..(182): Pfam Name: zf-DHHC Pfam Description: DHHC zinc finger domain
MHRSGTTMAWNVFKFCTALRGLGSIMILLVLGVVGVTYYAVVLTNYGPPLSQGGLDSLAALTILILFHFLLAMLLWSYFSVVFTDPGVVPPNWRPSTDEERGESDPLNSLDFVGLQSDSSSSNPRVRFCRKCNQLKPSRCHHCSVCGRCVLKMDHHCVWVVNCVGALNYKYFLLFLFYTFLETTLVTLVLMPHFIAFFSDEEIPGTPGTLATTFLAFVLNLAFALSVMGFLIMHISLVAGNTTTIEAYEKKTTTKWRYDLGKKKNFEQVFGMDKRYWLIPGYTEEDLRRMPELQGLEYPSKPDFDSQ

SEQ ID NO: 201 - protein, 304 aa, Glycine max
  misc_feature (1)..(304): Ceres CLONE ID no. 573293
  misc_feature (1)..(304): Functional Homolog of  Ceres CLONE ID no. 19340 at SEQ ID NO. 200 with e-value of 0.0 and percent identity of 85.5
MHRSGATMAWNVFKFCTALRGLGSIMILLVLGVVGATYYAVVLTNYGPALYAGGLDSLVALAVLILFHSLLVMLLWSYFSVVFTDPGSVPPNWKPTIDEERGEADPLVGTEFSNLPSDPNPRVRYCRKCNQLKPPRCHHCSVCGRCVLKMDHHCVWVVNCVGALNYKYFLLFLFYTFLETTLVTASLLPHFIAFFSDGEIPGTPGSLATTFLAFVLNLAFALSVLGFLIMHISLVAANTTTIEAYEKKTTPKWRYDLGRRKNFEQVFGMDKKYWFIPAYSDEDIRKMPALQGLDYPSKPDFDSQ

SEQ ID NO: 202 - protein, 307 aa, Glycine max
  misc_feature (1)..(307): Ceres CLONE ID no. 537080
  misc_feature (1)..(307): Functional Homolog of  Ceres CLONE ID no. 19340 at SEQ ID NO. 200 with e-value of 0.0 and percent identity of 78.6
MYRSGAGMAWNVFRFCTALRGLGSIMILMVLGVVGVTYYAVVLTNFGPALFLGGLDTLISFVVLILFHCLLVMLLWCYFAVVFMDPGTVPPNWKPAADEERGEVDPLNGVELSNLQSDPANQRFRYCRKCSQPKPPRCHHCSVCGRCVLKMDHHCVWVVNCVGALNYKYFLLFLVYTFLETTLVTISLLPHFKTYFSDGEIPGTPGTLATTFLTFVLNLAFSLSVLGFLVLHVSLVASNTTTIEAYEKKTTSKWRYDLGRRKNFEQVFGMDKRYWFIPAYSEEDIRRMPVLQGLEYPSTPDFNAQEF

SEQ ID NO: 203 - protein, 316 aa, Oryza sativa subsp. japonica
  misc_feature (1)..(316): Public GI No. 50919203
  misc_feature (1)..(316): Functional Homolog of  Ceres CLONE ID no. 19340 at SEQ ID NO. 200 with e-value of 1.69E-129 and percent identity of 76.8
MHRSAGATMAWNVFRFCTALRGLGSIMILLVLSIVGVTYYAVVVYNYGPALFAGGASTLLALVVLLLFHFLLVMLLWSYFSVVFTDPGSVPPNWNLDFDEERGETAPLSGLDFNSQVNSQQSIAHNDTGHPRARYCRKCNQMKPPRCHHCSVCGRCVLKMDHHCVWVVNCVGALNYKYFLLFLFYTFLETTLVTLSLLPHFIAFFSDIDIPGSPAALATTFLTFVLNLAFSLSVLGFMIMHVSLVSANTTTIEAYEKKTTPRWMYDIGRKRNFIQVFGNDKRYWFIPAYSEEDLRRMPVLQGLDYPVRTDLDGQEL

SEQ ID NO: 204 - protein, 180 aa, Zea mays
  misc_feature (1)..(180): Ceres CLONE ID no. 230342
  misc_feature (1)..(180): Functional Homolog of  Ceres CLONE ID no. 19340 at SEQ ID NO. 200 with e-value of 8.30E-128 and percent identity of 76.8
MYRSAGVAMAWNVFRFCTALRGLGSIMILLVLAIVGVTYYAVVLCNYGPALFTGGGTTLAALAVLLSFHFLLAMLLWSYFSVVFTDPGSVPPNWNLDFDVEMGETAPLASSELCSQMNSQQSVALGNMTNPRVRYCRKCNQLKPPRCHHCSVCGRCVLKMDHHCVWVVNCVGALNYKYFL

SEQ ID NO: 205 - DNA, 1307 bp, Arabidopsis thaliana
  misc_feature (1)..(1307): Ceres CLONE ID no. 207419
  misc_feature (1)..(1307): Also Known As Ceres CDNA ID no. 23371023
  misc_feature (1)..(1307): Also Known As Ceres GEMINI ID no. 539D5
aatttcaccgctctttctctttcgcttctctgagaagtttcaaagctaattcagctttcgagaaattgcaacaatggagaaactcgcggcgtctactgttacagatctagcttgcgtaacggcgataaactcaccaccgcctccactatcaccgatctctgaacaaagcttcagcaacaaacaccaagaagagttcgcagcaagcttcgcatcactctacaactcaattttctcaccggaatctcaattctctccttctcctccgtcctcttcctcaccaccatctcgcgtcgatacaactacagagcatcgtcttcttcaagcgaaacttatcctcgagtacgatgaactcaacgatcattacgagctttgccttaaccgtcttcaatctctaatgacggaacttgactctcttcgtcacgaaaacgattctctccgctttgaaaactcagatctactcaaacttattcatatctctacttcatcctcctcctccgtctctcctccggcgccgatccataaccgtcaattccgtcaccagatctccgattctcgctccgcgaagagaaacaatcaagagagaaactcgttgcctaagagcatctccgtcagatctcaaggatatctcaagatcaaccatggatttgaagcttcagatcgccaaacgagtcaactcagctctaactcggtgttgtcttctcaaaaggtgtgtgtagtacaaaccaaaggggagagagaagcattagagcttgaggtatatcgtcaagggatgatgaagacggagctttgtaacaaatggcaagagactggagcttgttgttacggcgataattgccaattcgctcacggaatcgacgagctacgtcctgtgattaggcatccacgctacaaaactgaggtttgcagaatgattgtcaccggagctatgtgtccttacggtcaccgttgccatttccgtcactcacttactgatcaagagaggatgatgatgatgatgcttactcgctgatctggagaagaagaagaaaggtcattgaaaaagagaaataattagtggttgtgtacagatttcagatttgataccttataaatatcgtaacttttctgggtatttgctataggaataaggaagagaaagtgtttaataaatgtttgataggattataggaatataattagggttgaagaaatgtgtggttctcggataaagctggagagacctgaaagaggatttagatttaacaaagatatggaatttgtattgataaaagtttttgactttgtgcaaaactatgcaactttcttcc

SEQ ID NO: 206 - protein, 311 aa, Arabidopsis thaliana
  misc_feature (1)..(311): Ceres CLONE ID no. 207419
  misc_feature (1)..(311): Also Known As Ceres CDNA ID no. 23371023
  misc_feature (1)..(311): Also Known As Ceres GEMINI ID no. 539D5
  misc_feature (272)..(298): Pfam Name: zf-CCCH Pfam Description: Zinc finger C-x8-C-x5-C-x3-H type ( and similar)
MEKLAASTVTDLACVTAINSPPPPLSPISEQSFSNKHQEEFAASFASLYNSIFSPESQFSPSPPSSSSPPSRVDTTTEHRLLQAKLILEYDELNDHYELCLNRLQSLMTELDSLRHENDSLRFENSDLLKLIHISTSSSSSVSPPAPIHNRQFRHQISDSRSAKRNNQERNSLPKSISVRSQGYLKINHGFEASDRQTSQLSSNSVLSSQKVCVVQTKGEREALELEVYRQGMMKTELCNKWQETGACCYGDNCQFAHGIDELRPVIRHPRYKTEVCRMIVTGAMCPYGHRCHFRHSLTDQERMMMMMLTR

SEQ ID NO: 207 - protein, 310 aa, Arabidopsis thaliana
  misc_feature (1)..(310): Public GI No. 12597770
  misc_feature (1)..(310): Functional Homolog of  Ceres CLONE ID no. 207419 at SEQ ID NO. 206 with e-value of 1.20E-159 and percent identity of 97.4
MEKLAASTVTDLACVTAINSSPPPLSPISEQSFNNKHQEEFAASFASLYNSIFSPESLSPSPPSSSSPPSRVDTTTEHRLLQAKLILEYDELNEHYELCLNRLQSLMTELDSLRHENDSLRFENSDLLKLIRISTSSSSSVSPPAPIHNRQFRHQISDSRSAKRNNQERNSLPKSISVRSQGYLKINHGFEASDLQTSQLSSNSVSSSQKVCVVQTKGEREALELEVYRQGMMKTELCNKWQETGACCYGDNCQFAHGIDELRPVIRHPRYKTEVCRMMVTGAMCPYGHRCHFRHSLTDQERMMMMMLTR

SEQ ID NO: 208 - protein, 318 aa, Zea mays
  misc_feature (1)..(318): Ceres CLONE ID no. 212775
  misc_feature (1)..(318): Functional Homolog of  Ceres CLONE ID no. 207419 at SEQ ID NO. 206 with e-value of 3.39E-45 and percent identity of 48.8
MEVVLAPAQHDGLHAAFGPNPFDIGVGGDGRISSSLSSLGGDRFCGYSTTASLFVNSPGLSSPSPRADSLSRGSSDSGSVVDDGDDAAATAPSVAERRLRLARLALQYQEVVNRFELCLSYLADAINEAAALRQENDELRVANEYLARRINVVGGRLADEFSGLRLAEEHTTPPPLSPLPAAPVMPKSISVRSPGYLKMIQNGKHRASKPTKGSRVLVGMEGGVKEEEKLNGGLQFEVYNQGMLKTELCNKWEETGTCPYGNQCQFAHGIAELRPVIRHPRYKTEVCRMVLAGVVCPYGHRCHFRHSITPADLFLPRP

SEQ ID NO: 209 - DNA, 589 bp, Arabidopsis thaliana
  misc_feature (1)..(589): Ceres CLONE ID no. 207629
  misc_feature (1)..(589): Also Known As Ceres GEMINI ID no. 531C2
atcacttacttaacatactaagagagttattagaacttgcaaaaaatggcttccaaggctttgattctgttaggtctcttctcagttcttctcgtcgtctccgaagtgtctgccgcaaggcaatcgggcatggtgaagccagagagtgaggaaactgtgcaacctgaaggttatggcggtggccacggaggacatggtggtcacggagggggaggaggccacggacatggaggacacaacggaggagggggccacggacttgacggatacggaggacactacggaggtggtggaggaggatacggaggtggaggaggacaccacggaggaggaggccacgggctaaacgaacctgttcagactaagccgggtgtttaaaactatataatatcttcactaccatgcatgattgcatatatatatatacgcttatgtattatctatatgcctataaataaaccatggtgagtttgtaacgcagtgccttcagaaatgttcggaataaatttccataatattagtataatgtctctctgtttgaattataaactgcgctgtttgcataataaaatctcttgtagctaggtcg

SEQ ID NO: 210 - protein, 110 aa, Arabidopsis thaliana
  misc_feature (1)..(110): Ceres CLONE ID no. 207629
  misc_feature (1)..(110): Also Known As Ceres GEMINI ID no. 531C2
  misc_feature (1)..(96): Pfam Name: GRP Pfam Description: Glycine rich protein family
MASKALILLGLFSVLLVVSEVSAARQSGMVKPESEETVQPEGYGGGHGGHGGHGGGGGHGHGGHNGGGGHGLDGYGGHYGGGGGGYGGGGGHHGGGGHGLNEPVQTKPGV

SEQ ID NO: 211 - protein, 133 aa, Arabidopsis thaliana
  misc_feature (1)..(133): Ceres CLONE ID no. 118184
  misc_feature (1)..(133): Functional Homolog of  Ceres CLONE ID no. 207629 at SEQ ID NO. 210 with e-value of 7.90E-52 and percent identity of 98.1
MASKALILLGLFSVLLVVSEVSAARQSGMVKPESEETVQPEGYGGGHGGHGGHGGGGGHGHGGHNGGGGHGLDGYGGGGGHYGGGGGHYGGGGGHYGGGGGHYGGGGGGHGGGGHYGGGGHGLNEPVQTKPGV

SEQ ID NO: 212 - protein, 112 aa, Arabidopsis thaliana
  misc_feature (1)..(112): Ceres CLONE ID no. 1006473
  misc_feature (1)..(112): Functional Homolog of  Ceres CLONE ID no. 207629 at SEQ ID NO. 210 with e-value of 3.19E-48 and percent identity of 96.9
MASKALILLGLFSVLLVVSEVSAARQSGMVKPESEETVQPEGYGGGHGGHGGHGGGGGHGHGGHNGGGGHGLDGYGGGGGHYGGGGGGHGGGGHYGGGGGGYGGGGGHHGGG

SEQ ID NO: 213 - protein, 123 aa, Arabidopsis thaliana
  misc_feature (1)..(123): Ceres CLONE ID no. 24667
  misc_feature (1)..(123): Functional Homolog of  Ceres CLONE ID no. 207629 at SEQ ID NO. 210 with e-value of 3.80E-52 and percent identity of 96.3
MASKALILLGLFSVLLVVSEVSAARQSGMVKPESEETVQPEGYGGGHGGHGGHGGGGGHGHGGHYGGGGGHYGGGGGHYGGGGGGHGGGGHYGGGGGGYGGGGGHHGGGGHGLNEPVQTKPGV

SEQ ID NO: 214 - protein, 127 aa, Arabidopsis thaliana
  misc_feature (1)..(127): Ceres CLONE ID no. 12459
  misc_feature (1)..(127): Functional Homolog of  Ceres CLONE ID no. 207629 at SEQ ID NO. 210 with e-value of 9.09E-51 and percent identity of 95.4
MASKALILLGLFAILLVVSEVSAARQSGMVKPESEETVQPEGYHGGHGGHGGGGHYGGGGHGHGGHNGGGGHGLDGYGGGHGGHYGGGGGHYGGGGGHGGGGHYGGGGHHGGGGHGLNEPVQTKPGV

SEQ ID NO: 215 - protein, 127 aa, Arabidopsis thaliana
  misc_feature (1)..(127): Ceres CLONE ID no. 1354021
  misc_feature (1)..(127): Functional Homolog of  Ceres CLONE ID no. 207629 at SEQ ID NO. 210 with e-value of 3.89E-50 and percent identity of 94.5
MASKALILLGLFAILLVVSEVSAARQSGMVKPESEATVQPEGYHGGHGGHGGGGHYGGGGHGHGGHNGGGGHGLDGYGGGHGGHYGGGGGHYGGGGGHGGGGHYGGGGHHGGGGHGLNEPVQTKPGV

SEQ ID NO: 216 - protein, 108 aa, Arabidopsis thaliana
  misc_feature (1)..(108): Ceres CLONE ID no. 3244
  misc_feature (1)..(108): Functional Homolog of  Ceres CLONE ID no. 207629 at SEQ ID NO. 210 with e-value of 1.70E-49 and percent identity of 93.4
MASKALILLGLFAILLVVSEVSAARQSGMVKPESEETVQPEGYHGGHGGHGGGGHYGGGGHGHGGHNGGGGHGLDGYGGGHGGHYGGGGHHGGGGHGLNEPVQTKPGV

SEQ ID NO: 217 - DNA, 1211 bp, Arabidopsis thaliana
  misc_feature (1)..(1211): Ceres CLONE ID no. 20769
  misc_feature (1)..(1211): Also Known As Ceres CDNA ID no. 23556763
  misc_feature (1)..(1211): Also Known As Ceres GEMINI ID no. 534G9
accatctctctctgtaatcgctcttctcgatgtcaactatttccttcttcctttgctcttagggttagggtttattttgttctttctctatatccttcaatcaatgtgaaaaaaaagctctcccttttggcagtttccgatgtttggtcgccattcgattatcccaaataaccagattggtaccgcctctgcttccgctggtgaagaccatgtctctgcctccgctacgtctggtcacattccttacgacgatatggaagaaatccctcatcctgactctatctatggtgctgcctccgatttgattcccgatggctctcaattggttgctcaccgatccgatggctctgaattacttgtttctcggccaccggaaggggcgaatcagcttacgatctcgttccgtggacaagtttacgtttttgatgccgttggtgctgacaaggtggatgctgtgttgtcgctgttgggtggttctactgagcttgctcctggtccgcaggtgatggaactagctcaacagcagaatcatatgcctgttgtagaatatcagagccgctgtagccttccgcaacgggcacaatccttggataggtttcggaagaagaggaatgctagatgtttcgagaagaaagtaagatacggtgttcgccaagaagttgccttaagaatggcacgtaataaaggtcaattcacctcttcaaagatgacagatggggcttataactctggcacagatcaagattctgcccaagatgatgcccatccagaaatatcgtgtactcattgcggcattagttccaaatgtacaccaatgatgcgacgtggcccttccggccccaggactctctgcaatgcctgtggacttttttgggctaacaggggtacattgagggatctctcaaagaaaacagaagagaatcagttggctttaatgaaaccggatgatggtgggagtgttgctgatgctgctaacaacttaaacactgaagctgcaagtgttgaagaacacacttccatggtttctcttgccaatggggataattctaatctgttaggtgatcactaaatactgtgataagaatcagaagatagaaatctttgtagaatcagatggtcttctctatgaatttatcttttcaccatcacatgtattatagaaaccgtaaccgaacctcaaatcaaataccatatcagatgtctttggttcc

SEQ ID NO: 218 - protein, 309 aa, Arabidopsis thaliana
  misc_feature (1)..(309): Ceres CLONE ID no. 20769
  misc_feature (1)..(309): Also Known As Ceres CDNA ID no. 23556763
  misc_feature (1)..(309): Also Known As Ceres GEMINI ID no. 534G9
  misc_feature (152)..(190): Pfam Name: CCT Pfam Description: CCT motif
  misc_feature (214)..(251): Pfam Name: GATA Pfam Description: GATA zinc finger
  misc_feature (77)..(112): Pfam Name: Zim Pfam Description: ZIM motif
MFGRHSIIPNNQIGTASASAGEDHVSASATSGHIPYDDMEEIPHPDSIYGAASDLIPDGSQLVAHRSDGSELLVSRPPEGANQLTISFRGQVYVFDAVGADKVDAVLSLLGGSTELAPGPQVMELAQQQNHMPVVEYQSRCSLPQRAQSLDRFRKKRNARCFEKKVRYGVRQEVALRMARNKGQFTSSKMTDGAYNSGTDQDSAQDDAHPEISCTHCGISSKCTPMMRRGPSGPRTLCNACGLFWANRGTLRDLSKKTEENQLALMKPDDGGSVADAANNLNTEAASVEEHTSMVSLANGDNSNLLGDH

SEQ ID NO: 219 - protein, 310 aa, Glycine max
  misc_feature (1)..(310): Ceres CLONE ID no. 477718
  misc_feature (1)..(310): Functional Homolog of  Ceres CLONE ID no. 20769 at SEQ ID NO. 218 with e-value of 3.49E-65 and percent identity of 53.6
MEPSAMYGPSQPLNIPSRIGAGERDDGSGNEPAVDGHHHHIQYETHALDDGAAGGAVVVEDVTSDAVYVSGGGGPEESSQLTLSFRGQVYVFDAVTPDKVQAVLLLLGGCELSSGGSPCVDPGAQQNQRGSMEFPKCSLPQRAASLDRFRQKRKERCFDKKVRYSVRQEVALRMHRNKGQFTSSKKQDGANSYGTDQDSGQDDSQSETSCKHCGTSSKSTPMMRRGPSGPRSLCNACGLFWANRGALRDLSKRNQEHSLPPVEQVDGGNDPDCRTAAADPAQNNLAAFSEPVNPALVADRKVFQSQKMLE

SEQ ID NO: 220 - protein, 307 aa, Glycine max
  misc_feature (1)..(307): Ceres CLONE ID no. 518521
  misc_feature (1)..(307): Functional Homolog of  Ceres CLONE ID no. 20769 at SEQ ID NO. 218 with e-value of 3.49E-65 and percent identity of 56.8
MEPSAMYGHSQPLSMPSQIGGGESDDGSGNEHAVDGHHHHIQYETHALEDGAAVVVEDVTSDAVYVSGGGGPVESSQLTLSFRGQVYVFDAVTPDKVQAVLLLLGGCELSSGGSPCVDPGAQHNQRGSMEFPKCSLPHRAASLHRFRQKRKERCFDKKVRYSVRQEVALRMHRNKGQFTSSKKQDGANSYGTDQDSGQDDSQSETSCTHCGISSKSTPMMRRGPSGPRSLCNACGLFWANRGALRDLSKRNQEHSLPPVEQVDEGNDSDCRTATADPAHNNLPAFSEHDNPALVADHKVFQSQKMLK

SEQ ID NO: 221 - DNA, 910 bp, Zea mays
  misc_feature (1)..(910): Ceres CLONE ID no. 208303
  misc_feature (1)..(910): Also Known As Ceres CDNA ID no. 23849426
  misc_feature (1)..(910): Also Known As Ceres GEMINI ID no. 538A5
gtttggagaaatccaattttctactcacggacgccgcccctgtgcctcgccatcgcctcaggtacgcaaggcggccgaacacgagcgcccgccttcgttcttgcctgcgctgcccctctcctcgccgtttattcgggctcctacctcttgttacaacttgcgcggtgggggcagtgaggcagcaagacgtgaggtccaggatgatgaacaacaacagtggcggcggtgccggaggccctggagggggcatgggtacgggagtgggtggagggggggacgggcggcacgacgacgaggctgcgctcaccgagttcctctcatccctcatggactacacccccacgattcccgacgagctggtggagcactacctcggccgcagcgggttccactgccccgacctgcgcctaacgagactggttgctgtagccacccagaagttcctatcagacattgctagcgattctcttcagcactgcaaggccagggtagcagcacctatcaaagacaataagagcaaacagccgaaggatagacgtcttgtattaaccatggatgatctttctaaagctttgcgcgagcacggcgtgaacttgaaacacgcggagtacttcgcagacagcccttcagctggaatggctccttcgaccagagaggagtagactggattaggccaacttgtacggaactagggagggatcgcgtggaatggatgggcatgttggcattcttgcccgatcagatcgatgggatgtattactattaagtactgctactatgactagtatatttctcaattaccattgtcactgagagaatccagacacaagtcgttttgcccatgcgcttttatttgtacaaactgtcaatcatctgtaaccctatggggcccaaggatgattgggcaaac

SEQ ID NO: 222 - protein, 137 aa, Zea mays
  misc_feature (1)..(137): Ceres CLONE ID no. 208303
  misc_feature (1)..(137): Also Known As Ceres CDNA ID no. 23849426
  misc_feature (1)..(137): Also Known As Ceres GEMINI ID no. 538A5
  misc_feature (31)..(81): Pfam Name: TFIID_30kDa Pfam Description: Transcription initiation factor TFIID 23-30kDa subunit
MGTGVGGGGDGRHDDEAALTEFLSSLMDYTPTIPDELVEHYLGRSGFHCPDLRLTRLVAVATQKFLSDIASDSLQHCKARVAAPIKDNKSKQPKDRRLVLTMDDLSKALREHGVNLKHAEYFADSPSAGMAPSTREE

SEQ ID NO: 223 - protein, 134 aa, Arabidopsis thaliana
  misc_feature (1)..(134): Ceres CLONE ID no. 25793
  misc_feature (1)..(134): Functional Homolog of  Ceres CLONE ID no. 208303 at SEQ ID NO. 222 with e-value of 1.50E-48 and percent identity of 75.7
MNHGQQSGEAKHEDDAALTEFLASLMDYTPTIPDDLVEHYLAKSGFQCPDVRLIRLVAVATQKFVADVASDALQHCKARPAPVVKDKKQQKDKRLVLTMEDLSKALREYGVNVKHPEYFADSPSTGMDPATRDE

SEQ ID NO: 224 - protein, 153 aa, Glycine max
  misc_feature (1)..(153): Ceres CLONE ID no. 1100893
  misc_feature (1)..(153): Functional Homolog of  Ceres CLONE ID no. 208303 at SEQ ID NO. 222 with e-value of 5.09E-64 and percent identity of 94.1
MMGSNNPGGAGGGGGMAPGTGAGGSDGRHDDEAVLTEFLSSLMDYNPTIPDELVEHYLGRSGFHCPDLRLTRLVAVAAQKFISDIASDSLQHCKARVAAPVKDNKSKQPKDRRLVLTMDDLSKALREHGVNLKHPEYFADSPSAGMAPSTREE

SEQ ID NO: 225 - protein, 136 aa, Flaveria trinervia
  misc_feature (1)..(136): Public GI No. 41529318
  misc_feature (1)..(136): Functional Homolog of  Ceres CLONE ID no. 208303 at SEQ ID NO. 222 with e-value of 1.09E-45 and percent identity of 70.6
MNHNQQSNEVRHDDENALSDFLASLTDYTPTIPDELVEHYLAKSGFQCPDVRLTRLVAVAAQKFVSDIAIDALQHCKARQAAVVRDKKEKQQRDKRLIMNMEDLSKALQEYGVNVKHQEYFADNPSAGLESAARDE

SEQ ID NO: 226 - protein, 138 aa, Triticum aestivum
  misc_feature (1)..(138): Ceres CLONE ID no. 1052135
  misc_feature (1)..(138): Functional Homolog of  Ceres CLONE ID no. 208303 at SEQ ID NO. 222 with e-value of 2.79E-63 and percent identity of 93.3
MAPGTGAGGSDGRHDDEAVLTEFLSSLMDYNPTIPDELVEHYLGRSGFHCPDIRLTRLVAVAAQKFISDIASDSLQHCKARVAAPIKDNKSKQPKDRRLVLTMDDLSKALREHGVNLKHPEYFADSPSAGMPPSTREE

SEQ ID NO: 227 - protein, 165 aa, Oryza sativa subsp. japonica
  misc_feature (1)..(165): Public GI No. 50726325
  misc_feature (1)..(165): Functional Homolog of  Ceres CLONE ID no. 208303 at SEQ ID NO. 222 with e-value of 1.79E-65 and percent identity of 94.0
MMGSNSAGGGGGGAMVPGGMGGGGPMGAAAAGGGGGGDGRHDDEAVLTEFLSSLMDYTPTIPDELVEHYLGRSGFYCPDLRLTRLVAVATQKFISDIASDSLQHCKARVAAPIKDNKSKQPKDRRLVLTMDDLSKALQEHGVNLKHPEYFADSPSAGMAPAAREE

SEQ ID NO: 228 - DNA, 499 bp, Arabidopsis thaliana
  misc_feature (1)..(499): Ceres CLONE ID no. 21075
  misc_feature (1)..(499): Also Known As Ceres CDNA ID no. 23386664
  misc_feature (1)..(499): Also Known As Ceres GEMINI ID no. 531F7
gattcatcgcagaaacttgacttttgagagagagagagaagaaatggattcatactcttcgccgccgatgggaggttcaggtagttcggtttcgcccgaagtaatgatggagtcggtcaagactcagctcgctcaagcttacgccgaagagttaatcgagactttgaggacaaaatgtttcgacaagtgcgtaacgaagccaggatcaagcctcggtggaagtgagagtagctgtatttcgagatgtgttgaacgttacatggaagctactgcaatcataagtcgttctcttttcactcaacgttgatcaattacagctacctcttcctttttaatgatcttgttgggatttgaagtataaaaaggttttatccagagtagaaaacaaaattacttttggttaaaagttggaagagttgcaactatcaattcgagaatggttatgtttctatatgttgttaattggttcaaagttcaagcttgtcccattgtgtgtttc

SEQ ID NO: 229 - protein, 87 aa, Arabidopsis thaliana
  misc_feature (1)..(87): Ceres CLONE ID no. 21075
  misc_feature (1)..(87): Also Known As Ceres CDNA ID no. 23386664
  misc_feature (1)..(87): Also Known As Ceres GEMINI ID no. 531F7
  misc_feature (22)..(86): Pfam Name: zf-Tim10_DDP Pfam Description: Tim10/DDP family zinc finger
MDSYSSPPMGGSGSSVSPEVMMESVKTQLAQAYAEELIETLRTKCFDKCVTKPGSSLGGSESSCISRCVERYMEATAIISRSLFTQR

SEQ ID NO: 230 - protein, 87 aa, Arabidopsis thaliana
  misc_feature (1)..(87): Public GI No. 14030607
  misc_feature (1)..(87): Functional Homolog of  Ceres CLONE ID no. 21075 at SEQ ID NO. 229 with e-value of 5.79E-40 and percent identity of 98.8
MDSYSSPPMGGSGSSVSPEVMMESVKTQLAQAYAEELIETLRTKCLDKCVTKPGSSLGGSESSCISRCVERYMEATAIISRSLFTQR

SEQ ID NO: 231 - protein, 87 aa, Arabidopsis thaliana
  misc_feature (1)..(87): Public GI No. 5107082
  misc_feature (1)..(87): Functional Homolog of  Ceres CLONE ID no. 21075 at SEQ ID NO. 229 with e-value of 5.19E-39 and percent identity of 97.6
  misc_feature (34)..(34): Xaa is any aa, unknown, or other
  misc_feature (52)..(52): Xaa is any aa, unknown, or other
MDSYSSPPMGGSGSSVSPEVMMESVKTQLAQAYXEELIETLRTKCFDKCVTXPGSSLGGSESSCISRCVERYMEATAIISRSLFTQL

SEQ ID NO: 232 - protein, 67 aa, Zea mays
  misc_feature (1)..(67): Ceres CLONE ID no. 392743
  misc_feature (1)..(67): Functional Homolog of  Ceres CLONE ID no. 21075 at SEQ ID NO. 229 with e-value of 1.39E-22 and percent identity of 77.6
MEQIKTQLAQAYAQEFLETVGNKCFEKCVTKPGSSLSGSESSCISRCVDRYIEATGIVSRALFTSQR

SEQ ID NO: 233 - protein, 87 aa, Brassica napus
  misc_feature (1)..(87): Ceres CLONE ID no. 1090803
  misc_feature (1)..(87): Functional Homolog of  Ceres CLONE ID no. 21075 at SEQ ID NO. 229 with e-value of 6.99E-28 and percent identity of 75.0
MDSYSSSSPPMGASPSPEALMEQIQAQLAEAYAKELIETMREKCFDKCITKPGSSLSSGESSCISRCVDRYLEATGIISRSLFSQQR

SEQ ID NO: 234 - protein, 86 aa, Brassica napus
  misc_feature (1)..(86): Ceres CLONE ID no. 946808
  misc_feature (1)..(86): Functional Homolog of  Ceres CLONE ID no. 21075 at SEQ ID NO. 229 with e-value of 3.50E-26 and percent identity of 75.0
MDFSSPSPPMGSGQSPEALMEQVQAQLQQAYAEELIETLRGKCFDKCVTKPGSSLSSGESSCVSRCVDRYIEAMGIVSRSLFSQQR

SEQ ID NO: 235 - protein, 88 aa, Brassica napus
  misc_feature (1)..(88): Ceres CLONE ID no. 1086365
  misc_feature (1)..(88): Functional Homolog of  Ceres CLONE ID no. 21075 at SEQ ID NO. 229 with e-value of 8.99E-28 and percent identity of 73.8
MDSYSSSSPPMGASPSPEALMEQIQAQLAEAYAKELIETMREKCFDKCITKPGSSLSSGESSCVSRCVDRYLEATGIISRSLFSQQRH

SEQ ID NO: 236 - protein, 87 aa, Zea mays
  misc_feature (1)..(87): Ceres CLONE ID no. 373100
  misc_feature (1)..(87): Functional Homolog of  Ceres CLONE ID no. 21075 at SEQ ID NO. 229 with e-value of 1.49E-27 and percent identity of 71.2
MDSFSSSPSSSGPGANPDVVMEQIKTQLAQAYAQEFLETVGNKCFEKCVTKPGSSLSGSESSCISRCVDRYIEATGIVSRALFTSQR

SEQ ID NO: 237 - protein, 88 aa, Triticum aestivum
  misc_feature (1)..(88): Ceres CLONE ID no. 1323425
  misc_feature (1)..(88): Functional Homolog of  Ceres CLONE ID no. 21075 at SEQ ID NO. 229 with e-value of 2.49E-25 and percent identity of 71.0
MDSFSSPSMSSSGSSPNPEALMEQIKAQLAQAYAQELLETVGNKCFAKCVTKPGSSMSGSESSCVSRCVDRYIEATGHRRPGFVQSPL

SEQ ID NO: 238 - protein, 87 aa, Triticum aestivum
  misc_feature (1)..(87): Ceres CLONE ID no. 617980
  misc_feature (1)..(87): Functional Homolog of  Ceres CLONE ID no. 21075 at SEQ ID NO. 229 with e-value of 9.99E-29 and percent identity of 69.3
MDSFSSPSMSSSGSSPNPEALMEQIKAQLAQAYAQELLETVGNKCFAKCVTKPGSSLSGSESSCVSRCVDRYIEATGIVGRALFSHR

SEQ ID NO: 239 - protein, 84 aa, Oryza sativa subsp. japonica
  misc_feature (1)..(84): Public GI No. 50251897
  misc_feature (1)..(84): Functional Homolog of  Ceres CLONE ID no. 21075 at SEQ ID NO. 229 with e-value of 9.50E-24 and percent identity of 67.9
MDSFSSSSGSPPNTEALMDQIKAQLAQAYAQEFLETVGNKCFAKCVTKPGSSLSGSESSCISRCVDRYIEATGIVSRALFSSTR

SEQ ID NO: 240 - protein, 84 aa, Oryza sativa
  misc_feature (1)..(84): Public GI No. 5107149
  misc_feature (1)..(84): Functional Homolog of  Ceres CLONE ID no. 21075 at SEQ ID NO. 229 with e-value of 6.70E-23 and percent identity of 67.5
  misc_feature (78)..(78): Xaa is any aa, unknown, or other
  misc_feature (81)..(81): Xaa is any aa, unknown, or other
MDSFSSSSGSPPNTEALMDQIKAQLAQAYAQEFLETVGNKCFAXCVTKPGSSLSGSESSCISRCVDRYIEATGIVSRXLFXSTR

SEQ ID NO: 241 - protein, 86 aa, Oryza sativa subsp. japonica
  misc_feature (1)..(86): Public GI No. 50928231
  misc_feature (1)..(86): Functional Homolog of  Ceres CLONE ID no. 21075 at SEQ ID NO. 229 with e-value of 3.99E-25 and percent identity of 65.8
MDSFSSPSSAGSTASTEHLMEQIKAQLAQAYAQEFLETVGNKCFAKCVTKPGTSLSGSESSCISRCVDRYIEATGIVSRALFSSQR

SEQ ID NO: 242 - protein, 84 aa, Glycine max
  misc_feature (1)..(84): Ceres CLONE ID no. 714267
  misc_feature (1)..(84): Functional Homolog of  Ceres CLONE ID no. 21075 at SEQ ID NO. 229 with e-value of 4.69E-22 and percent identity of 60.7
MDSFSNPSSGSSHQLSAHDLKNQLKNQLAIEYAQQFLETVGRKCFEKCVTKPGSSLGGSESSCISRCVDRYIEATGIISKALFS

SEQ ID NO: 243 - protein, 86 aa, Glycine max
  misc_feature (1)..(86): Ceres CLONE ID no. 584348
  misc_feature (1)..(86): Functional Homolog of  Ceres CLONE ID no. 21075 at SEQ ID NO. 229 with e-value of 4.69E-22 and percent identity of 59.7
MDSFSNQSRGSSSQLSAQDLKNQLKNQLAIEYAQQFLETVGRKCFEKCVTKPGSSLGGSESSCISRCVDRYIEATGIISKALFSSQ

SEQ ID NO: 244 - DNA, 1558 bp, Arabidopsis thaliana
  misc_feature (1)..(1558): Ceres CLONE ID no. 21240
  misc_feature (1)..(1558): Also Known As Ceres GEMINI ID no. 553C1
aaaaccaaaacgatggcgtttcatcacaatcatctctcacaagacctctccttcaatcatttcaccgaccaacaccaacctccacctccgcaaccgcctcctcctcctccgcaacagcaacaacatttccaagaagcaccgcctcctaattggttaaacacagcgcttcttcgttcctcagataacaacaataacttcctcaacctccacacagccaccgctaacaccacaaccgcaagcagctccgattctccttcctccgccgccgccgccgccgctgctaaccagtggctatctctctcctcctctttcctccaacgaaacaacaacaacaacgcttccatagtcggagatgggatcgatgatgtcaccggaggagcagacactatgattcagggagagatgaaaaccggcggtggagaaaacaaaaacgacggcggaggagctacggcggcggatggagtagtgagctggcagaatgcgagacacaaggcggagatcctttcgcatcctctttacgagcagcttttgtcggcgcacgttgcttgtttgagaatcgcgactccggttgatcagcttccgagaatcgatgctcagcttgctcagtctcaacacgtcgtcgctaaatactcagctttaggcgccgccgctcaaggtctcgtcggcgacgataaagaacttgaccagttcatgacacattatgtgttgctactgtgttcatttaaagagcaattgcaacaacatgtgcgtgttcatgcaatggaagctgtgatggcttgttgggagattgagcagtctcttcaaagcttaacaggagtgtctcctggagaagggatgggagcaacaatgtctgacgatgaagatgaacaagtagagagtgatgctaatatgttcgatgggggattagatgtgttgggttttggtcctttgattcctactgagagtgagaggtcgttgatggaaagagttagacaagaacttaaacatgaactcaaacagggttacaaggagaagatagtagacataagagaggagatattaaggaagagaagagctgggaagttaccaggagataccacctctgttctcaaagcttggtggcaatctcattccaaatggccttaccctactgaggaagataaggcgaggttggtgcaagagacaggtttgcagctaaaacagataaacaattggttcatcaatcagagaaagaggaactggcatagcaatccatcttcttccactgtattgaagaacaaacgcaaaagcaatgcaggtgacaatagcggaagagagcggttcgcgtagaaacaacaaacatatgatgtgaattggggaggtggaagatgggatttgaaagcagggttttagggatttaaagttgagaattttatggaggagtttggattatacagagagaggggacagtattagaaagtaactttttgtgcaattacatagtaacgtagtttggttatgtgattatgcccatatattttattaagtagcacacaaaccaaaaagaaaatatgaaaactgaagatgcaggcttttgttc

SEQ ID NO: 245 - protein, 431 aa, Arabidopsis thaliana
  misc_feature (1)..(431): Ceres CLONE ID no. 21240
  misc_feature (1)..(431): Also Known As Ceres GEMINI ID no. 553C1
  misc_feature (157)..(201): Pfam Name: KNOX1 Pfam Description: KNOX1 domain
  misc_feature (213)..(268): Pfam Name: KNOX2 Pfam Description: KNOX2 domain
  misc_feature (322)..(343): Pfam Name: ELK Pfam Description: ELK domain
MAFHHNHLSQDLSFNHFTDQHQPPPPQPPPPPPQQQQHFQEAPPPNWLNTALLRSSDNNNNFLNLHTATANTTTASSSDSPSSAAAAAAANQWLSLSSSFLQRNNNNNASIVGDGIDDVTGGADTMIQGEMKTGGGENKNDGGGATAADGVVSWQNARHKAEILSHPLYEQLLSAHVACLRIATPVDQLPRIDAQLAQSQHVVAKYSALGAAAQGLVGDDKELDQFMTHYVLLLCSFKEQLQQHVRVHAMEAVMACWEIEQSLQSLTGVSPGEGMGATMSDDEDEQVESDANMFDGGLDVLGFGPLIPTESERSLMERVRQELKHELKQGYKEKIVDIREEILRKRRAGKLPGDTTSVLKAWWQSHSKWPYPTEEDKARLVQETGLQLKQINNWFINQRKRNWHSNPSSSTVLKNKRKSNAGDNSGRERFA

SEQ ID NO: 246 - protein, 393 aa, Arabidopsis thaliana
  misc_feature (1)..(393): Public GI No. 1045044
  misc_feature (1)..(393): Functional Homolog of  Ceres CLONE ID no. 21240 at SEQ ID NO. 245 with e-value of 3.90E-168 and percent identity of 87.9
MAFHNNHFNHFTDQQQHQPPPPPQQQQQQHFQESAPPNWLLRSDNNFLNLHTAATAAATSSDSPSSAAANQWLSRSSSFLQRGNTANNNNNETSGDVIEDVPGGEESMIGEKKEAERWQNARHKAEILSHPLYEQLLSAHVACLRIATPVDQLPRIDAQLAQSQNVVAKYSTLEAAQGLLAGDDKELDHFMTHYVLLLCSFKEQLQQHVRVHAMEAVMACWEIEQSLQSFTGVSPGEGTGATMSEDEDEQVESDAHLFDGSLDGLGFGPLVPTESERSLMERVRQELKHELKQGYKEKIVDIREEILRKRRAGKLPGDTTSVLKSWWQSHSKWPYPTEEDKARLVQETGLQLKQINNWFINQRKRNWHSNPSSSTVSKNKRRSNAGENSGRDR

SEQ ID NO: 247 - protein, 393 aa, Arabidopsis thaliana
  misc_feature (1)..(393): Public GI No. 26451634
  misc_feature (1)..(393): Functional Homolog of  Ceres CLONE ID no. 21240 at SEQ ID NO. 245 with e-value of 9.99E-168 and percent identity of 87.6
MAFHNNHFNHFTDQQQHQPPPPPQQQQQQHFQESAPPNWLLRSDNNFLNLHTAASAAATSSDSPSSAAANQWLSRSSSFLQRGNTANNNNNETSGDVIEDVPGGEESMIGEKKEAERWQNARHKAEILSHPLYEQLLSAHVACLRIATPVDQLPRIDAQLAQSQNVVAKYSTLEAAQGLLAGDDKELDHFMTHYVLLLCSFKEQLQQHVRVHAMEAVMACWEIEQSLQSFTGVSPGEGTGATMSEDEDEQVESDAHLFDGSLDGLGFGPLVPTESERSLMERVRQELKHELKQGYKEKIVDIREEILRKRRAGKLPGDTTSVLKSWWQSHSKWPYPTEEDKARLVQETGLQLKQINNWFINQRKRNWHSNPSSSTVSKNKRRSNAGENSGRDR

SEQ ID NO: 248 - DNA, 1554 bp, Zea mays
  misc_feature (1)..(1554): Ceres CLONE ID no. 222894
  misc_feature (1)..(1554): Also Known As Ceres GEMINI ID no. 538E11
gatgcaaacctatttatattctgtccttaattcccgtgtttctcgtccgtctccgctcctccgcaaccccttcccctcctccgccgaagcctctcctccggccgccgaaaccctagcctccgccgctgccgtcatggcaagcagcaacgtctcgaccgtttacatctctgtcattgatgacgtcatctccaaggtccgcgaggatttcatcacctacggagtcggtgacgccgtcctaaacgagctccaggctctctgggagatgaaaatgctacactgtggcgcgatctcggggaacatagaccgaaccaaggctgctgccgcgtccgtcggaggcaccaccggcacgacagcgcccgtgcacgacctgaacgtgccgtacgaggccacatctgaggagtacgccaccccgaccgctgacatgttgttcccgccgacaccattgcagaccccaatccagactcctctgccagggacagacacagcgatgtacaacatacccactggcccttccgattatgccccctcaccgatcagcgatgtcaggaatgggatggcaataaatggggcagacccaacagctggtcatccaagtccctacatgccaccaccttccccttggatgaatcagaggccgctgggtgttgatgtgaatgtcgcttatgtggaaggccgtgaagatcctgacaggggcgtgcagcctcagccactgactcaggatttttttatgatgtcttctgggaaacgcaagagggatgagtatcctggtcagctcccttctggttcttttgtaccacaacaagatggaagtgctgatcagatagtagaatttgttgtgtcaaaggaaaatgtgaatcaactttggagttccatcggcaataagcttgaaacaccaaccaagacaatcactccagttattccacagcgtgatgggattcaagataactacaatgatcaatttttctttccaggagttccaaccgaagattataatacccctggagaatctgcggagtatcgagctcctacacctgctgttggaacaccaaaacaaagaaatgatgctggagatgatgataatgatgatgatgatgatgaacctcctcttaatgaagacgacgacgaggagttagatgaccttgagcaaggggaggatgaacctaacacacaacatcttgtacttgcacaatttgataaagtgtcaaggaccaagaatcgttggaagtgcaccttgaaggatggaatcatgcatttgaatggcagggatgtcctttttaacaaggcgacaggtgagtttgatttttgattttttggatgaagatgagctattttagaagcagctgtatggacatatctttgtcttgacataaggacagggaggtgacagtgttcttggtggggtcctggcagcatgactgcgtcgtgttttctttcctattgaatcttcgttccaccctcttgtttgtcaccgcaactgttatcgctgtaaagaagttactgcttgtgctgtgtagacaatttctgatatgggtctctcaaatccgctgcgtaact

SEQ ID NO: 249 - protein, 390 aa, Zea mays
  misc_feature (1)..(390): Ceres CLONE ID no. 222894
  misc_feature (1)..(390): Also Known As Ceres GEMINI ID no. 538E11
  misc_feature (307)..(390): Pfam Name: TFIIA Pfam Description: Transcription factor IIA, alpha/beta subunit
MASSNVSTVYISVIDDVISKVREDFITYGVGDAVLNELQALWEMKMLHCGAISGNIDRTKAAAASVGGTTGTTAPVHDLNVPYEATSEEYATPTADMLFPPTPLQTPIQTPLPGTDTAMYNIPTGPSDYAPSPISDVRNGMAINGADPTAGHPSPYMPPPSPWMNQRPLGVDVNVAYVEGREDPDRGVQPQPLTQDFFMMSSGKRKRDEYPGQLPSGSFVPQQDGSADQIVEFVVSKENVNQLWSSIGNKLETPTKTITPVIPQRDGIQDNYNDQFFFPGVPTEDYNTPGESAEYRAPTPAVGTPKQRNDAGDDDNDDDDDEPPLNEDDDEELDDLEQGEDEPNTQHLVLAQFDKVSRTKNRWKCTLKDGIMHLNGRDVLFNKATGEFDF

SEQ ID NO: 250 - protein, 375 aa, Arabidopsis thaliana
  misc_feature (1)..(375): Public GI No. 39545932
  misc_feature (1)..(375): Functional Homolog of  Ceres CLONE ID no. 222894 at SEQ ID NO. 249 with e-value of 2.30E-93 and percent identity of 56.1
MGTTTTTSAVYIHVIEDVVNKVREEFINNGGPGESVLSELQGIWETKMMQAGVLNGPIERSSAQKPTPGGPLTHDLNVPYEGTEEYETPTAEMLFPPTPLQTPLPTPLPGTADNSSMYNIPTGSSDYPTPGTENGVNIDVKARPSPYMPPPSPWTNPRLDVNVAYVDGRDEPERGNSNQQFTQDLFVPSSGKRKRDDSSGHYQNGGSIPQQDGAGDAIPEANFECDAFRITSIGDRKVPRDFFSSSSKIPQVDGPMPDPYDEMLSTPNIYSYQGPSEEFNEARTPAPNEIQTSTPVAVQNDIIEDDEELLNEDDDDDELDDLESGEDMNTQHLVLAQFDKVTRTKSRWKCSLKDGIMHINDKDILFNKAAGEFDF

SEQ ID NO: 251 - protein, 390 aa, Glycine max
  misc_feature (1)..(390): Ceres CLONE ID no. 1168684
  misc_feature (1)..(390): Functional Homolog of  Ceres CLONE ID no. 222894 at SEQ ID NO. 249 with e-value of 1.40E-102 and percent identity of 61.8
MAASTTSQVYIQVIDDVMNKVRDEFVNNGGPGDEVLKELQSIWESKMMQAGAIVGPIERSGAPKPTPGGPITPVHDLNMPYEGTEEYETPTAEMLFPPTPLQTPLQTPLPGTVDNSMYNIPTGPSDYPSAGNEPGANNEIKGGRPGPYMQPPPSTWTNQNQNQRAPLDVNVAYVEGRDEAERGASNQPLTQDFFMSSGKRKRDEIASQYNAGGYIPQQDGAGDAASQIFEIEVYGGGMSIDAGHSTSKGKMPAQSDRPASQIPQLDGPIPYDDDVLSTPNIYNYGVFNEDYNIANTPAPSEVPASTPAPIAQNEVDEEDDDDEPPLNENDDDDLDDLDQGEDQNTHHLVLAQFDKVTRTKSRWKCTLKDGIMHINNKDILFNKATGEFDF

SEQ ID NO: 252 - DNA, 1202 bp, Arabidopsis thaliana
  misc_feature (1)..(1202): Ceres CLONE ID no. 22339
  misc_feature (1)..(1202): Also Known As Ceres GEMINI ID no. 535A11
gttagatgatctgtccatttttttcttttttcttctgtgtataaatatatttgagcacaaagaaaaactaataaccttctgttttcagcaagtagggtcttataaccttcaaagaaatattccttcaattgaaaacccataaaccaaaatagatattacaaaaggaaagagagatattttcaagaacaacataattagaaaagcagaagcagcagttaagtggtactgagataaatgatatagtttctcttcaagaacagtttctcattacccaccttctcctttttgctgatctatcgtaatcttgagaactcaggatcaatggaggaaggtgggagtagtcacgacgcagagagtagcaagaaactagggagagggaaaatagagataaagaggatagagaacacaacaaatcgtcaagttactttctgcaaacgacgcaatggtcttctcaagaaagcttatgaactctctgtcttgtgtgatgccgaagttgccctcgtcatcttctccactcgtggccgtctctatgagtacgccaacaacagtgtgaggggtacaattgaaaggtacaagaaagcttgttccgatgccgtcaaccctccttccgtcaccgaagctaatactcagtactatcagcaagaagcctctaagcttcggaggcagattcgagatattcagaattcaaataggcatattgttggggaatcacttggttccttgaacttcaaggaactcaaaaacctagaaggacgtcttgaaaaaggaatcagccgtgtccgctccaaaaagaatgagctgttagtggcagagatagagtatatgcagaagagggaaatggagttgcaacacaataacatgtacctgcgagcaaagatagccgaaggcgccagattgaatccggaccagcaggaatcgagtgtgatacaagggacgacagtttacgaatccggtgtatcttctcatgaccagtcgcagcattataatcggaactatattccggtgaaccttcttgaaccgaatcagcaattctccggccaagaccaacctcctcttcaacttgtgtaactcaaaacatgataacttgtttcttcccctcataacgattaagagagagacgagagagttcattttatatttataacgcgactgtgtattcatagtttaggttctaataatgataataacaaaactgttgtttc

SEQ ID NO: 253 - protein, 248 aa, Arabidopsis thaliana
  misc_feature (1)..(248): Ceres CLONE ID no. 22339
  misc_feature (1)..(248): Also Known As Ceres GEMINI ID no. 535A11
  misc_feature (24)..(74): Pfam Name: SRF-TF Pfam Description: SRF-type transcription factor ( DNA-binding and dimerisation domain)
  misc_feature (89)..(188): Pfam Name: K-box Pfam Description: K-box region
MEEGGSSHDAESSKKLGRGKIEIKRIENTTNRQVTFCKRRNGLLKKAYELSVLCDAEVALVIFSTRGRLYEYANNSVRGTIERYKKACSDAVNPPSVTEANTQYYQQEASKLRRQIRDIQNSNRHIVGESLGSLNFKELKNLEGRLEKGISRVRSKKNELLVAEIEYMQKREMELQHNNMYLRAKIAEGARLNPDQQESSVIQGTTVYESGVSSHDQSQHYNRNYIPVNLLEPNQQFSGQDQPPLQLV

SEQ ID NO: 254 - protein, 246 aa, Arabidopsis thaliana
  misc_feature (1)..(246): Public GI No. 52548134
  misc_feature (1)..(246): Functional Homolog of  Ceres CLONE ID no. 22339 at SEQ ID NO. 253 with e-value of 1.69E-105 and percent identity of 86.1
MEDGASNEVAESSKKIGRGKIEIKRIENTTNRQVTFCKRRNGLLKKAYELSVLCDAEVALVIFSTRGRLYEYANNSVRGTIERYKKACSDAVNPPTITEANTQYYQQEASKLRRQIRDIQNLNRHILGESLGSLNFKELKNLESRLEKGISRVRSKKHEMLVAEIEYMQKREIELQNDNMYLRSKITERTGLQQQESSVIHQGTVYESGVTSSHQSGQYNRNYIAVNLLEPNQNSSNQDQPPLQLV

SEQ ID NO: 255 - protein, 246 aa, Arabidopsis thaliana
  misc_feature (1)..(246): Public GI No. 52548152
  misc_feature (1)..(246): Functional Homolog of  Ceres CLONE ID no. 22339 at SEQ ID NO. 253 with e-value of 1.19E-104 and percent identity of 86.4
MEGGASNEVAESSKKIGRGKIEIKRIENTTNRQVTFCKRRNGLLKKAYELSVLCDAEVALVIFSTRGRLYEYANNSVRGTIERYKKACSDAVNPPTITEANTQYYQQEASKLRRQIRDIQNLNRHILGESLGSLNFKELKNLESRLEKGISRVRSKKHEMLVAEIEYMQKREIELQNDNMYLRSKITERTGLQQQESSVIHQGTAYESGVTSSHQSGQYNRNYIAVNLLEPNQNSSNQDQPPLQLV

SEQ ID NO: 256 - protein, 248 aa, Arabidopsis thaliana
  misc_feature (1)..(248): Ceres CLONE ID no. 103400
  misc_feature (1)..(248): Functional Homolog of  Ceres CLONE ID no. 22339 at SEQ ID NO. 253 with e-value of 6.50E-104 and percent identity of 86.8
MEGGASNEVAESSKKIGRGKIEIKRIENTTNRQVTFCKRRNGLLKKAYELSVLCDAEVALVIFSTRGRLYEYANNSVRGTIERYKKACSDAVNPPTITEANTQYYQQEASKLRRQIRDIQNLNRHILGESLGSLNFKELKNLESRLEKGISRVRSKKHEMLVAEIEYMQKRVKEIELQNDNMYLRSKITERTGLQQQESSVIHQGTVYESGVTSSHQSGQYNRNYIAVNLLEPNQNSSNQDQPPLQLV

SEQ ID NO: 257 - protein, 249 aa, Brassica napus
  misc_feature (1)..(249): Public GI No. 17223670
  misc_feature (1)..(249): Functional Homolog of  Ceres CLONE ID no. 22339 at SEQ ID NO. 253 with e-value of 5.20E-118 and percent identity of 92.7
MDEGGSSHDAESSKKIGRGKIEIKRIENTTNRQVTFCKRRNGLLKKAYELSVLCDAEVALVIFSTRGLLYEYASNSVKGTIERYKKACSDAVNPPTVTEANTKHYQQEASKLRRQIRDIQNSNRHIVGESLGSLNFKELKNLEGRLEKGISRVRSKKSELLVAEIEYMQKREMELQHVNMYLRAKIEQGARLNPEQHGSGVIQGTAVYESGLSSSHDQSQHYNRNYIPVNLLEPNQQFSGQDQPPLQLV

SEQ ID NO: 258 - protein, 242 aa, Malus x domestica
  misc_feature (1)..(242): Public GI No. 16973296
  misc_feature (1)..(242): Functional Homolog of  Ceres CLONE ID no. 22339 at SEQ ID NO. 253 with e-value of 2.99E-83 and percent identity of 70.6
MEFANQAPESSTQKKLGRGKIEIKRIENTTNRQVTFCKRRNGLLKKAYELSVLCDAEVALIVFSTRGRLYEYANNSVRATIDRYKKACADSTDGGSVSEANTQFYQQEASKLRRQIREIQNSNRHILGESLSTLKVKELKNLEGRLEKGISRIRSKKNEILFSEIEFMQKRETELQHHNNFLRAKIAESEREQQQQQTHMIPGTSYDPSMPSNSYDRNFFPVILESNNNHYPRQGQTALQLV

SEQ ID NO: 259 - protein, 242 aa, Malus x domestica
  misc_feature (1)..(242): Public GI No. 33308109
  misc_feature (1)..(242): Functional Homolog of  Ceres CLONE ID no. 22339 at SEQ ID NO. 253 with e-value of 9.99E-83 and percent identity of 71.3
MEFPNQAPESSSQKKLGRGKIEIKRIENTTNRQVTFCKRRNGLLKKAYELSVLCDAEVALIVFSNRGRLYEYANNSVRATIDRYKKAYADPTNSGSVSEANTQFYQQEASKLRRQIREIQNSNRHILGEALSSLNAKELKNLEGRLEKGISRIRSKKNEMLFSEIEFMQKRETELQHHNNFLRAKIAENEREEQQHTHMMPGTSYDQSMPSHSYDRNFLPAVILESNNNHYPHQVQTALQLV

SEQ ID NO: 260 - protein, 242 aa, Glycine max
  misc_feature (1)..(242): Ceres CLONE ID no. 1043518
  misc_feature (1)..(242): Functional Homolog of  Ceres CLONE ID no. 22339 at SEQ ID NO. 253 with e-value of 3.80E-83 and percent identity of 72.9
MEDPNQAQEGSSQKKMGRGKIEIKRIENTTNRQVTFCKRRNGLLKKAYELSVLCDAEVALVVFSTRGRLYEYANNSVRATIERYKKANAAASNAESVSEANTQFYQQESSKLRRQIRDIQNLNRHILGEALGSLSLKELKNLEGRLEKGLSRVRSRKHETLFADVEFMQKREIELQNHNNYLRAKIAEHERAQQQQSNMMSGTLCESLPSQSYDRNFFPVNLIASDDQQQYSSQDHTALQLV

SEQ ID NO: 261 - protein, 243 aa, Glycine max
  misc_feature (1)..(243): Ceres CLONE ID no. 1046745
  misc_feature (1)..(243): Functional Homolog of  Ceres CLONE ID no. 22339 at SEQ ID NO. 253 with e-value of 1.59E-13 and percent identity of 57.6
  misc_feature (82)..(82): Xaa is any aa, unknown, or other
  misc_feature (111)..(111): Xaa is any aa, unknown, or other
MEDPNQAQEGSSQKKMGRGKIEIKRIENTTNRQVTFCKRRNGLLKKAYELSVLCDAEVALVVFSTRGRLYEYANNSVRATIXRYKKANAAASNAESVSEANTQFYQQESSXLRRQIRDIQNLNRHILGEALGSLSLKELKNLEGRLEKGLSRVRSRKHETLFADIEFMQKREIELQNHNNFLRAKIAENERAQQRQQDMIPGTECESTIPNSQSYDRNFFPVNLIDSNNNQYSRQDQTALQLV

SEQ ID NO: 262 - protein, 241 aa, Pisum sativum
  misc_feature (1)..(241): Public GI No. 62132641
  misc_feature (1)..(241): Functional Homolog of  Ceres CLONE ID no. 22339 at SEQ ID NO. 253 with e-value of 4.90E-83 and percent identity of 75.3
MELPNEGGEGSSQKKLGRGKIEIKRIENTTNRQVTFCKRRNGLLKKAYELSVLCDAEVALVVFSTRGRLYEYANNSVRATIERYKKACAASTNAESVSEANTQFYQQESSKLRRQIRDIQNLNRHILGEALGSLSLKELKNLEGRLEKGLSRVRSRKHETLFADVEFMQKREIELQNHNNYLRAKIAEHERAQQQQQNLMPETMCESLPSQTYDRNFFPVNLLGSDQQEYSRQDQTALQLV

SEQ ID NO: 263 - protein, 225 aa, Vitis vinifera
  misc_feature (1)..(225): Public GI No. 14279306
  misc_feature (1)..(225): Functional Homolog of  Ceres CLONE ID no. 22339 at SEQ ID NO. 253 with e-value of 3.39E-82 and percent identity of 75.5
MGRGKIEIKRIENTTNRQVTFCKRRNGLLKKAYELSVLCDAEVALIVFSSRGRLYEYANNSVRTTIERYKKVCSDSSNTGSVSEANAQFYQQEASKLRRQIRDIQNLNRHILGEALSSLNFKELKNLETRLEKGISRIRSKKNELLFAEIEYMQKREIELQNSNLFLRAQIAENERAQQQMNLMPGSQYESVPQQPYDSQNLLPVNLLDPNHHYSRHDQTALQLV

SEQ ID NO: 264 - protein, 235 aa, Arabidopsis lyrata subsp. petraea
  misc_feature (1)..(235): Public GI No. 52548104
  misc_feature (1)..(235): Functional Homolog of  Ceres CLONE ID no. 22339 at SEQ ID NO. 253 with e-value of 3.29E-116 and percent identity of 96.5
  misc_feature (144)..(144): Xaa is any aa, unknown, or other
  misc_feature (145)..(145): Xaa is any aa, unknown, or other
MEEGRSSHDGESSKKIGRGKIEIKRIENTTNRQVTFCKRRNGLLKKAYELSVLCDAEVALVIFSTRGRLYEYANNSVRGTIERYKKACSDAVNPPXVTEANTQYYQQEASKLRRQIRDIQNSNRHIVGESLGSLNFKELKNLEXXLEKGISRVRSKKNELLVAEIEYMQKREMELQHNNMYLRAKIAEGARLNPEQQESSVIQGTTVYESGVSSHDQSQHHNRNYIPVNLLEPNQ

SEQ ID NO: 265 - DNA, 782 bp, Zea mays
  misc_feature (1)..(782): Ceres CLONE ID no. 225321
  misc_feature (1)..(782): Also Known As Ceres CDNA ID no. 23748264
  misc_feature (1)..(782): Also Known As Ceres GEMINI ID no. 552C9
agcgagagtagcggtcgtggatgattctgccttttcttctccttccctcacctgctctctctctctctccctttctttcccgcggcgacggtgacgacgaccgcgcgagcgccgccgactccctactgcatcaggtgcctcggccttcgtcgtgctctccgccggcaacgagtatagacgggcgcgcatggccaccttcgagctgtaccggaggtccaccatcggcatgtgcctcaccgagacgctcgacgagatggtctccaacggcaccctcagcccggagctcgctatccaggtcctcgtccagttcgacaagtccatgacggatgctctggagaaccaagtgaagagcaaggttactgtcaagggtcacctgcacacctacaggttctgtgacaacgtgtggaccttcatcttgacagacgcaagcttcaagaatgaggaggccacggagcaggtgggcaaggtgaagattgtggcatgtgattccaaattgctcggacaataggcctgtgtaccctcgaggtcaaggaaggaagcttttaagtgcggcgaggcggggtctgtctgcgcgtcagctgtacacgcctaggctaccgcgaggcggggtctgtctgcgtcagctgtacacgcctaggctaccgcccgaacggcatttcatttgccttcttcgtactgtatgtgtatcttcttttttccccttgtatacaatctgctgcagctataccggccaagagtatggcatggtatggcggcaggcagccgcaaacttgtttttacct

SEQ ID NO: 266 - protein, 106 aa, Zea mays
  misc_feature (1)..(106): Ceres CLONE ID no. 225321
  misc_feature (1)..(106): Also Known As Ceres CDNA ID no. 23748264
  misc_feature (1)..(106): Also Known As Ceres GEMINI ID no. 552C9
  misc_feature (2)..(50): Pfam Name: TFIIA_gamma_N Pfam Description: Transcription initiation factor IIA, gamma subunit, helical domain
  misc_feature (52)..(101): Pfam Name: TFIIA_gamma_C Pfam Description: Transcription initiation factor IIA, gamma subunit, beta-barrel domain
MATFELYRRSTIGMCLTETLDEMVSNGTLSPELAIQVLVQFDKSMTDALENQVKSKVTVKGHLHTYRFCDNVWTFILTDASFKNEEATEQVGKVKIVACDSKLLGQ

SEQ ID NO: 267 - protein, 106 aa, Zea mays
  misc_feature (1)..(106): Ceres CLONE ID no. 1541168
  misc_feature (1)..(106): Functional Homolog of  Ceres CLONE ID no. 225321 at SEQ ID NO. 266 with e-value of 5.00E-50 and percent identity of 98.1
MATFELYRRSTIGMCLTETLDEMVSNGTLSPELAIQVLVQFDKSMTDALENQVKSKVTVKGHLHTYRFCDNVWTFILTDASFKNEEATEQVGKVKIVACDSKGRGQ

SEQ ID NO: 268 - protein, 106 aa, Triticum aestivum
  misc_feature (1)..(106): Ceres CLONE ID no. 699465
  misc_feature (1)..(106): Functional Homolog of  Ceres CLONE ID no. 225321 at SEQ ID NO. 266 with e-value of 5.69E-49 and percent identity of 95.2
MATFELYRRSTIGMCLTETLDEMVSSGTLSPELAIQVLVQFDKSMTEALENQVKSKVTVKGHLHTYRFCDNVWTFILTDAQFKNEETTEQVGKVKIVACDSKLLSQ

SEQ ID NO: 269 - protein, 106 aa, Oryza sativa subsp. indica
  misc_feature (1)..(106): Public GI No. 55585039
  misc_feature (1)..(106): Functional Homolog of  Ceres CLONE ID no. 225321 at SEQ ID NO. 266 with e-value of 8.39E-48 and percent identity of 92.4
MATFELYRRSTIGMCLTETLDEMVSSGTLSPELAIQVLEQFDKSMTEALENQVKSKVSIKGHLHTYRFCDNVWTFILTEASFKNEETTEQVGKVKIVACDSKLLSQ

SEQ ID NO: 270 - protein, 109 aa, Oryza sativa subsp. japonica
  misc_feature (1)..(109): Public GI No. 57899877
  misc_feature (1)..(109): Functional Homolog of  Ceres CLONE ID no. 225321 at SEQ ID NO. 266 with e-value of 7.79E-45 and percent identity of 89.4
MATFELYRRSTIGMCLTDTLDDMVSSGALSPELAIQVLVQFDKSMTSALEHQVKSKVTVKGHLHTYRFCDNVWTFILTDAIFKNEEITETINKVKIVACDSKLLETKEE

SEQ ID NO: 271 - protein, 106 aa, Glycine max
  misc_feature (1)..(106): Ceres CLONE ID no. 530235
  misc_feature (1)..(106): Functional Homolog of  Ceres CLONE ID no. 225321 at SEQ ID NO. 266 with e-value of 2.09E-44 and percent identity of 86.9
MATFELYRRSTIGMCLTETLDEMVQNGTLSPELAIQVLVQFDKSMTEALETQVKSKVSIKGHLHTYRFCDNVWTFILQDALFKSEDSQEIVGRVKIVACDSKLLTQ

SEQ ID NO: 272 - protein, 106 aa, Arabidopsis thaliana
  misc_feature (1)..(106): Ceres CLONE ID no. 8364
  misc_feature (1)..(106): Functional Homolog of  Ceres CLONE ID no. 225321 at SEQ ID NO. 266 with e-value of 6.29E-43 and percent identity of 83.1
MATFELYRRSTIGMCLTETLDEMVQSGTLSPELAIQVLVQFDKSMTEALESQVKTKVSIKGHLHTYRFCDNVWTFILQDAMFKSDDRQENVSRVKIVACDSKLLTQ

SEQ ID NO: 273 - protein, 106 aa, Arabidopsis thaliana
  misc_feature (1)..(106): Public GI No. 1429228
  misc_feature (1)..(106): Functional Homolog of  Ceres CLONE ID no. 225321 at SEQ ID NO. 266 with e-value of 1.10E-36 and percent identity of 76.4
MATFELYRRSTIGMCLTETLDEMVQSGTVSPELAIQVLVQFDKSMTEALESQVKTKVSIKGHLHHLQVRDNVWTFILQDAMFKSYDRQENVSPVKIVASDSKLLTQ

SEQ ID NO: 274 - DNA, 1190 bp, Zea mays
  misc_feature (1)..(1190): Ceres CLONE ID no. 232839
  misc_feature (1)..(1190): Also Known As Ceres GEMINI ID no. 536H8
agcctttcactttcaaacaatcacaacacaatccaaaggacgacgagggagagggagcgaaaaagccagagcaagagcaagagacgaacgatcaagagtcaagggagcgaaggaccgatggccgaccccagctattgggattggatggacatcgaagacctcgtcctgcccgtcgtcatctttgccagcgtcaccgtggccccgtggctcgtcgtattcattttcttgtacatcaagcaatggtggcgcgtcttcaggctcggcggcgtcaccaccctgaggcggaacctgagccgaaactgcgtcctgtgccaacaaagcctggaggccggtgagaaggtccgcacgctctcctgcaaccacgagttccactacggccgcagcgtcaagtgcgagggcatcgaccactggcttcttatgagggaaccgattaattactgcccgcagtgtcgcaagtttccccgttccgtgcagccgtggaataccttgttgggaggggcaccgtcgtcagcaccttcgcaggaagcatcggcggcagcgcaacaacagttgccgcggacgtcgtcgacgcgggatttggaggacccgcttcttccggggcacggcgagacacggacgtcgacgacgcttccggtggacgacgagatagtagaggaggcgccttcatcgcagtcgacacgcgctgccgtggaaacggacagcgccaccgtcgccaccaccttcacaaaaagcatcggcggcagcgcaacaacagttgccgcggaagtcgtcgtcgacgcgggatttggaggacccactgcttccgaggcacggcgagaaacggacgccgaggccgcttcagttccggtggacagcgagatagtagaggaggcgccttcatcgcagtacacgcgcgtgatcaagcttggataggacgctgttgacacgtcctgtgggccggtctggaactggatcagttctcgcagaggttcttcaaggattctttcgtcatttctttttctgcattctttggaactgatcgagggtagtgcgtctttctgatgatcggtgttcagcttttgcttgcttcgaactcatcaagcttagttgcgttcctgttcttttgttcagacttcagatttgagtccaccttaacgaaccaaaatgtctgaatgccaagaaacgatgacttgttagttcttggatcagct

SEQ ID NO: 275 - protein, 264 aa, Zea mays
  misc_feature (1)..(264): Ceres CLONE ID no. 232839
  misc_feature (1)..(264): Also Known As Ceres GEMINI ID no. 536H8
MADPSYWDWMDIEDLVLPVVIFASVTVAPWLVVFIFLYIKQWWRVFRLGGVTTLRRNLSRNCVLCQQSLEAGEKVRTLSCNHEFHYGRSVKCEGIDHWLLMREPINYCPQCRKFPRSVQPWNTLLGGAPSSAPSQEASAAAQQQLPRTSSTRDLEDPLLPGHGETRTSTTLPVDDEIVEEAPSSQSTRAAVETDSATVATTFTKSIGGSATTVAAEVVVDAGFGGPTASEARRETDAEAASVPVDSEIVEEAPSSQYTRVIKLG

SEQ ID NO: 276 - DNA, 1202 bp, Zea mays
  misc_feature (1)..(1202): Ceres CLONE ID no. 232985
  misc_feature (1)..(1202): Also Known As Ceres GEMINI ID no. 537B2
ttagcaaagcgtacatccctccaacaaaccttgagttgagagaggagagaggagagaggagacagcaagcgacacaacacagaggtaaccggctcacgcctgtctcggtggccgtgggcaatcatggccactgtgggacagtccggggccctgaggagggtcaccgtgcactacgccaactcgcccacaggcagcacggtggcagaggtgagctttgacgaccttgacgacgagctgctcctgtttgtgctcgccgatcttcttcctggccaggaaggtttacaccagtcgatcttggaaggaacatacaacaaccaggagaaccacatgagaggtgcagcacccagtgcaccatatggttattcacggccagaggaataccgtgcagagagcagcactgctgcagcagcagcaactggttctaggaattcaggcatggatgaacagatcgcctcggacttcgagtacgccaagcagctgcagcaggagatggaggacctcagcgtcaaagacgaagacgacaacgatatcagctgcgtgccgtctccatctgactctgacgatgagcacgagcatcatgacgaagaggaagaggctgacaggcaggaggacggtgatggtgatgatggtccagacaacatgacttatgagcaaggacaggcacttgtagaatctgtggggactgagtacagaggtctatccgatgagctcatctcctacctgcagtcatggaagtacaagtcttcagggctcttctcccggaaaacaaaccatgaagactgcccgatctgcctgtccactttcagaaaccgggaaaccatgataacgttgccgtgcaggcatcactaccacgcagcttgtgtcaccagatggctcaaggtcaacaagacatgccctgtatgcaaatacgaactgtttggaccttcctaggatccgaccacgtcgacgatggagctgagaagataatgatgatgacgacgacaacgacagatggttgtgtcatctgctctctttttttagcgccaagaaaactggaaatgaaaaagggaaatcaatccgaaaggagaatagaaattaggaagtataggtagaatatctctcttgccagtgactatgtatttgttgtgcgatgaattaagcatacctcgtgctatttatgatgtattggatttttttatatataagaacttccccgtggaatc

SEQ ID NO: 277 - protein, 268 aa, Zea mays
  misc_feature (1)..(268): Ceres CLONE ID no. 232985
  misc_feature (1)..(268): Also Known As Ceres GEMINI ID no. 537B2
  misc_feature (220)..(260): Pfam Name: zf-C3HC4 Pfam Description: Zinc finger, C3HC4 type (RING finger)
MATVGQSGALRRVTVHYANSPTGSTVAEVSFDDLDDELLLFVLADLLPGQEGLHQSILEGTYNNQENHMRGAAPSAPYGYSRPEEYRAESSTAAAAATGSRNSGMDEQIASDFEYAKQLQQEMEDLSVKDEDDNDISCVPSPSDSDDEHEHHDEEEEADRQEDGDGDDGPDNMTYEQGQALVESVGTEYRGLSDELISYLQSWKYKSSGLFSRKTNHEDCPICLSTFRNRETMITLPCRHHYHAACVTRWLKVNKTCPVCKYELFGPS

SEQ ID NO: 278 - protein, 268 aa, Zea mays
  misc_feature (1)..(268): Ceres CLONE ID no. 304618
  misc_feature (1)..(268): Functional Homolog of  Ceres CLONE ID no. 232985 at SEQ ID NO. 277 with e-value of 8.00E-107 and percent identity of 81.2
MATVGQSGALRRVTVHYASSPTRGAVVEVSLDDLDDELLQFVLADLLPGQEGLHQSILEGAHGSNQENYMRGAGSSAPSQEYHAQSSTAAAAAAASSRRNPGTDDAQIASDFEYATKLQQEMEGLSVDDDGDGISCVPSPSDSDDGHDHHDEEDEDEEDGNGGGDDDDDPDNMTYEQRQALVESVGSEDRGLSDELISYLQPWKYKASGFFSRKTNHDDCPICLSTFRNRETMITLPCMHHYHAACVTKWLRVNKTCPVCKYELFGPC

SEQ ID NO: 279 - protein, 261 aa, Oryza sativa subsp. japonica
  misc_feature (1)..(261): Public GI No. 34898016
  misc_feature (1)..(261): Functional Homolog of  Ceres CLONE ID no. 232985 at SEQ ID NO. 277 with e-value of 2.80E-72 and percent identity of 58.9
MATVGQPDAMRRITVHYVNPPPIAGAGEAHVDGLDDEVLDYVIGDVLQDQEGLYQSILYGKYGDDMRGARNTALAQSDGLHYYYHGENSSGEATTSRNSEIDQQIEYDLVFARQLQAMDNLTIETPADEDDDISCVPSPSDSETDEPAEGNNEEAATQDDNDDPDNMTYEQRQALVESVGNENRGLSDLLISYLETWKYKSGFFPRKANHDNCPICLSAFRRRETLITLACKHSYHEGCIARWLKIDKACPVCKYEVFGPS

SEQ ID NO: 280 - DNA, 1616 bp, Zea mays
  misc_feature (1)..(1616): Ceres CLONE ID no. 237356
  misc_feature (1)..(1616): Also Known As Ceres CDNA ID no. 23782013
  misc_feature (1)..(1616): Also Known As Ceres GEMINI ID no. 537E10
gttcggtcagcccacctgcttattcggcgggcgggcgggcgcagattgcactggagtatgtagtgctctctggttttcgcaaaaaagaaaagcttgctaatagtctggtcatggccgggttttgtgttgctacttttagctactgattgctcgctagcaaagttggtggcctttgtgtaagatggcactacctctgcatccttccttcctttcctacgctgtatctctttctttctttctgtgttttctttctttctttctgtgtgattgtgtgtggaattcggccgctcctcggctctctatatagcgacgcccggcccgcacacagacagctccagagtccagacgcctgatcggaaagcaacgtcgttgccccccccccccacctcgtcacgagtcagagagctacacaacaaccatcctgttcccgcccgcatacaggactctagctagctagctagcgttgttccgttgtggttgctctcgctcgctctcgttcggtcgatcatggagtggagggacagcttcttggacctggcgctcatcccgctcagcctgctcctccccatggcgtaccacgcctggctgtggcgcgaggtccgcctccgcccgctgcgcacggccgtcggcatcaacgccgccacgcgccgcctctgggccatcggcatgatgaaggacaacgccaagaacgcggtgacggtggtgcagtcggtgcggaacgtcatcatggggtcgacgctgatggccacgacggcgatcctcttctgcacgggcgtggcagcggtgctgagcagcacctacaccatcaagaagccgctcagcgacaccgtgttcggcgcgcacggcgagtacatgatggcgctcaagtacgtggcgctcatgctgctcttcctcctcgccttcctctgccactccctcgccatctgcttcctcaaccaggccagcttcctcatcaacacctcggcctgcctcttctcctcctccgccgactccgacgccgccgtcctcggcctcccgctgccgcccaccagggactacatcggcgacgtcctggagcgcggcttcaccctcaacctcgtcggcaacaggctcttctacgccggggtgcccctcctgctctggatcttcggcccgctcctcgccttcctgtcctccatggtcatggtccccatactctacagcctcgacgtcgtcaacctcatgggccacagcggatgcgtcgtcgtcagcggcaaatctgcggagatgaacggcgggagcgagtgcgcgcgtgccgtctgaagctgccggacttgtgtcctcaacaaaccatatgcatgcgatccgtacatgtgattcggttgagactgttgccgcgcgcaacggcctgtgatgtgtcgagcaccaaggagacggcatgttgttcgtcgtcgtcgttctctcattcatgtggggttataggctagccgcgcgccgtcgtagctgatgctgatgtactaggaaaaccttcgttgcatggatgacacggaacccataccccacgcggttcagttgctttgctgctcttggtgctcgacaagttgacagtgtgtgccactacaacacatattccaagtcggctttatctcttcctgtcc

SEQ ID NO: 281 - protein, 257 aa, Zea mays
  misc_feature (1)..(257): Ceres CLONE ID no. 237356
  misc_feature (1)..(257): Also Known As Ceres CDNA ID no. 23782013
  misc_feature (1)..(257): Also Known As Ceres GEMINI ID no. 537E10
  misc_feature (10)..(239): Pfam Name: DUF599 Pfam Description: Protein of unknown function, DUF599
MEWRDSFLDLALIPLSLLLPMAYHAWLWREVRLRPLRTAVGINAATRRLWAIGMMKDNAKNAVTVVQSVRNVIMGSTLMATTAILFCTGVAAVLSSTYTIKKPLSDTVFGAHGEYMMALKYVALMLLFLLAFLCHSLAICFLNQASFLINTSACLFSSSADSDAAVLGLPLPPTRDYIGDVLERGFTLNLVGNRLFYAGVPLLLWIFGPLLAFLSSMVMVPILYSLDVVNLMGHSGCVVVSGKSAEMNGGSECARAV

SEQ ID NO: 282 - protein, 239 aa, Arabidopsis thaliana
  misc_feature (1)..(239): Public GI No. 15293233
  misc_feature (1)..(239): Functional Homolog of  Ceres CLONE ID no. 237356 at SEQ ID NO. 281 with e-value of 1.69E-63 and percent identity of 56.1
MEWRECYLDVILVPLGLMVYASYHVYLWHKLRTQPLTTIIGTNARARRFWVASIIKDNDKKNILAVQTLRNCIMGSTLMATTSILLCAGLAAVLSSTYAVKKPLNDAVFGARGEFMVALKYVTILTIFLFSFFSHSLSIRFINQVNILINTPFPPEELEDEMMMTAEEYVAELLERGFILNTVGNRLFYAALPLMLWIFGPVLVFLCSVVMVPLLYNLDFFFFGKERRKLDQKSSFGSV

SEQ ID NO: 283 - protein, 233 aa, Glycine max
  misc_feature (1)..(233): Ceres CLONE ID no. 562000
  misc_feature (1)..(233): Functional Homolog of  Ceres CLONE ID no. 237356 at SEQ ID NO. 281 with e-value of 9.99E-66 and percent identity of 60.2
MEWRKCYLDVILVPLVFLTSIGYHFWLWHKVRTQPHTTIIGINASGRRNWVNAMMKDNDKKNILAVQSLRNTIMGATLMATTSILLCSGLAAVISSTYSVKKPLNDAVYGAHGEFMVALKYVTLLTIFLFSFFCHSLSIRFINQVNILINTPQDPMSLVTPQYIKEILEKGFILNTVGNRLFYAGLPLLLWIFGPVLVFLCSLTMVPVLYNLDFVFTSGKGKVDANEINRDFV

SEQ ID NO: 284 - protein, 263 aa, Triticum aestivum
  misc_feature (1)..(263): Ceres CLONE ID no. 736573
  misc_feature (1)..(263): Functional Homolog of  Ceres CLONE ID no. 237356 at SEQ ID NO. 281 with e-value of 2.49E-87 and percent identity of 73.3
MVVWRDSYLDLILVPLGLLLPALYHAWLWRAVRRRPLSTAFGVYSAARRLWAAGMMRDNDDKKGVLVVQSIRNVIMGSTLMATTSVLFCTGIAAVLSSTYSVKKPLSDAVFGAHGEYMMALKYVALLLVFLFAFLCHTLTICFLNQASFLINTSCLPLPDAGKDDDGARLVGVQLPAGAVSYYVGEILERSFTLNFVGNRLFYAGVPLLLWIFGPLLAFLSSLVMIPILYNLDMVNVAADRGAKEHSSGCINGKANGNGFMQV

SEQ ID NO: 285 - protein, 250 aa, Oryza sativa subsp. japonica
  misc_feature (1)..(250): Public GI No. 50947691
  misc_feature (1)..(250): Functional Homolog of  Ceres CLONE ID no. 237356 at SEQ ID NO. 281 with e-value of 8.70E-85 and percent identity of 72.9
MAWKDSYLDLVLIPAGIVFPIVYHVWLWHVVRRRPLSSTVGINTATRRLWVLGMMKDNEKKAVLVVQSMRNVIMGSTLMATTAILFCTGVAAILSSTYTVKKPLSDAVFGAHGEYMMALKYVTLLLAFLLSFLSHTTAICTLNQATFLLNTLSSSSSFAADIAGLPVTKDYVADVLERGFLLNLVGNRLFYAGVPLLLWIFGPVLACLCSVVMIPILHSIDVVYVDGSSKGEANARVEMVYESDESVMQV

SEQ ID NO: 286 - DNA, 1350 bp, Zea mays
  misc_feature (1)..(1350): Ceres CLONE ID no. 241491
  misc_feature (1)..(1350): Also Known As Ceres GEMINI ID no. 552B6
agcacttgtgtccggcggccttgtgttcgtgggggtgtgtggcatattagctagcggataagcggccggccgaagagcgcgcaagcgcagtgagaagaagaagcaagctcggatcggaggaggtcggcatggggaggggacgcgtcgagctgaagcggatcgagaacaagatcaaccgccaggtcaccttctccaagcgccgcaacggcctgctcaagaaggcctacgagctctccgtgctctgcgacgccgaggtcgcgctcatcatcttctccggccgcggcaagctctacgagttcggcagcgccggcgtaactaaaactttagaaaggtatcaacatttctgctacaatgctcaagattccaacaatggtgcactctctgaatctcagagctggtaccaggaaatatcaaaactgagggcaaaattcgaggccttgcagcgcactcagagacacttgcttggggaggaccttggcccactgagtactgtgaaggaattgcagcagctagagaaacagctagaatgtgctttgtcacaggcaagacagagaaagacgcaacttatgatggagcaagtggaagagcttcgccgaacggtattttatactagactttgtttacaatagtaaaactgatctacagcatagtaggttgatacaccgtagccagctcgggcatatatatactctatatatcgcatgcacagcagggataatcatatggacgttctttagctgaaaaactgtctgtgtaggtaggtatgcctatatatgtgtcttccgatccttgtactcttctgcacaacagattcagccgttcaccttaatgtctaaagtattcgccacattctcatggactgcgcaggagcgtcacctgggagaaatgaacaggcaactcaaacacaagctcgaagctgaaggctgtagcaactacacaaccttgcagcatgccgcctgctggccagctcccggcggcaccatcgtggagcatgacggcgccacctatcaagtgcatccgcctgcccactcagttgctatggactgtgaacccactctgcaaatcgggtaccctcatcaccagtttccgccccctgaggcagccaataatatcccaaggagcgccgccacaggcgagaacaacttcatgctgggatgggttctttgagttcttctgttaatccatccatcagatggatccatgttgaaaccaataaaaggcattcagtgctatatatatcatatgcatatccgtgctcaagtgcttgatttgccacgacgttggattgtatcgttctgtgtgtaatagctaatttagaacggcacatctattctatgtggttgtggtgtg

SEQ ID NO: 287 - protein, 160 aa, Zea mays
  misc_feature (1)..(160): Ceres CLONE ID no. 241491
  misc_feature (1)..(160): Also Known As Ceres GEMINI ID no. 552B6
  misc_feature (74)..(156): Pfam Name: K-box Pfam Description: K-box region
  misc_feature (9)..(59): Pfam Name: SRF-TF Pfam Description: SRF-type transcription factor ( DNA-binding and dimerisation domain)
MGRGRVELKRIENKINRQVTFSKRRNGLLKKAYELSVLCDAEVALIIFSGRGKLYEFGSAGVTKTLERYQHFCYNAQDSNNGALSESQSWYQEISKLRAKFEALQRTQRHLLGEDLGPLSTVKELQQLEKQLECALSQARQRKTQLMMEQVEELRRTVFY

SEQ ID NO: 288 - DNA, 682 bp, Arabidopsis thaliana
  misc_feature (1)..(682): Ceres CLONE ID no. 250028
  misc_feature (1)..(682): Also Known As Ceres GEMINI ID no. 539C4
ctagagaaatctcttcttctagttctagtctcctgcttcttcgagatcgtgtgtcgtaactcgtaagctagggaagccctttttgtcttcgaatttcggctagattcaaaccatggttggaagacgagtatcacctgctctaactaaggatgatgcgcattcatacatcattgctgtgaaggaaacatttcatgatgaacctacgaaatatcaagagtttatcaagctcttgaatggtgtttgtgatcatagagtcgataaatatagtgtcattgcaagggtggaggaactgatgaaagatcatcaggatcttcttcttggtttcagtgtcttccttccacctgtttctgtagaggattttataaacaagctcaagacacggtttcagagccttgatactcatgtagtgggggcaattcgcgggttaatgaagatgtttaaagagggaaagatgtcggtaaaggaggtgcaagaggaggtcattgatgtcctcttctatcatgaagatttgattgaagactttctcagatttttcacaaagaaccctgtatcaacagcatcactactactacaattataacgagtgatgtattttttatgaatgagaatggagtgtatagtttcttttgtagaggttttaaatctttgcttttcaccatgaagaggatgagatttgaatttg

SEQ ID NO: 289 - protein, 155 aa, Arabidopsis thaliana
  misc_feature (1)..(155): Ceres CLONE ID no. 250028
  misc_feature (1)..(155): Also Known As Ceres GEMINI ID no. 539C4
  misc_feature (96)..(142): Pfam Name: PAH Pfam Description: Paired amphipathic helix repeat
MVGRRVSPALTKDDAHSYIIAVKETFHDEPTKYQEFIKLLNGVCDHRVDKYSVIARVEELMKDHQDLLLGFSVFLPPVSVEDFINKLKTRFQSLDTHVVGAIRGLMKMFKEGKMSVKEVQEEVIDVLFYHEDLIEDFLRFFTKNPVSTASLLLQL

SEQ ID NO: 290 - DNA, 497 bp, Arabidopsis thaliana
  misc_feature (1)..(497): Ceres CLONE ID no. 25795
  misc_feature (1)..(497): Also Known As Ceres CDNA ID no. 23362339
  misc_feature (1)..(497): Also Known As Ceres GEMINI ID no. 554G8
cttcttgtttctcgagatttattctctttctctctctctttctctgtgtgtttcgtgtcttcagattagttcgatgtttcgttcagacaaggcggaaaaaatggataaacgacgacggagacagagcaaagccaaggcttcttgttccgaagaggtgagtagtatcgaatgggaagctgtgaagatgtcagaagaagaagaagatctcatttctcggatgtataaactcgttggcgacaggtgggagttgatcgccggaaggatcccgggacggacgccggaggagatagagagatattggcttatgaaacacggcgtcgtttttgccaacagacgaagagacttttttaggaaatgattttttttgtttggattaaaagaaaattttcctctccttaattcacaagacaagaaaaaaaggaaatgtacctgtccttgaattactattttggaatgtataattatctatatatataagaagaaaaaattgcttaggt

SEQ ID NO: 291 - protein, 94 aa, Arabidopsis thaliana
  misc_feature (1)..(94): Ceres CLONE ID no. 25795
  misc_feature (1)..(94): Also Known As Ceres CDNA ID no. 23362339
  misc_feature (1)..(94): Also Known As Ceres GEMINI ID no. 554G8
  misc_feature (35)..(80): Pfam Name: Myb_DNA-binding Pfam Description: Myb-like DNA-binding domain
MFRSDKAEKMDKRRRRQSKAKASCSEEVSSIEWEAVKMSEEEEDLISRMYKLVGDRWELIAGRIPGRTPEEIERYWLMKHGVVFANRRRDFFRK

SEQ ID NO: 292 - protein, 85 aa, Brassica napus
  misc_feature (1)..(85): Ceres CLONE ID no. 1104601
  misc_feature (1)..(85): Functional Homolog of  Ceres CLONE ID no. 25795 at SEQ ID NO. 291 with e-value of 1.10E-38 and percent identity of 94.1
MDRRRRRQSKAKASCSEEVSSIEWEAVKMTEEEEDLISRMYKLVGDRWELIAGRIPGRTPEEIERYWLMKHGVVFANRPRDFVRR

SEQ ID NO: 293 - DNA, 810 bp, Arabidopsis thaliana
  misc_feature (1)..(810): Ceres CLONE ID no. 261609
  misc_feature (1)..(810): Also Known As Ceres GEMINI ID no. 539H4
acactcactcaatcatacctttctctggagacctccacagggtttgtttccggaaatgtcgaacggcacggatcaggctcaaccaccaccggagaacccggctactccggtggattcgaagtcacggaaacgtgcgacgccaggggatgataattggcttcctcctgattggagaaccgaaattagggttcgaacctctggcactaaagctggtactgttgataagttctactacgaaccgattacgggtcgtaagttccggtccaagaacgaggttttgtactatttggaacacgggacgcctaaaaagaagtccgtcaagacagcggaaaacggagactcacattccgaacattctgaaggtagaggaagcgctaggcggcagacaaaatccaacaaaaaggttactgagccaccgccaaagccgttgaacttcgattttctgaatgtgccggagaaggttacttggactgggataaacggttcagaagaaacttggttgcctttcattggggactacaagattcaagaatctgtcagccaagattgggacagagtattcactcttgtcacctcccaaaacgctggaaaaacgatgttctagaagattgctgcagaaactcacaaattgtaataacacgcgctgctagattatcatatctacttagtatttactgatcgttggttggaatgcaggttaattttttagtagtgatagttttagtaacactttgatttgagttgtaatgtactttcttaacattttcttagataatttgaaggcaatgtatgtctatattattgcctttg

SEQ ID NO: 294 - protein, 182 aa, Arabidopsis thaliana
  misc_feature (1)..(182): Ceres CLONE ID no. 261609
  misc_feature (1)..(182): Also Known As Ceres GEMINI ID no. 539H4
  misc_feature (25)..(137): Pfam Name: MBD Pfam Description: Methyl-CpG binding domain
MSNGTDQAQPPPENPATPVDSKSRKRATPGDDNWLPPDWRTEIRVRTSGTKAGTVDKFYYEPITGRKFRSKNEVLYYLEHGTPKKKSVKTAENGDSHSEHSEGRGSARRQTKSNKKVTEPPPKPLNFDFLNVPEKVTWTGINGSEETWLPFIGDYKIQESVSQDWDRVFTLVTSQNAGKTMF

SEQ ID NO: 295 - DNA, 800 bp, Arabidopsis thaliana
  misc_feature (1)..(800): Ceres CLONE ID no. 26867
  misc_feature (1)..(800): Also Known As Ceres CDNA ID no. 23390265
  misc_feature (1)..(800): Also Known As Ceres GEMINI ID no. 535B8
aaaacaacactcaaaagtctcttcttcttcttcttcacatcgatcatcatacaacaacaaaaaatggattacagagaatccaccggtgaaagtcagtcaaagtacaaaggaatccgtcgtcggaaatggggcaaatgggtatcagagattagagttccgggaactcgtgaccgtctctggttaggttcattctcaacagcagaaggcgccgccgtagcacacgacgttgctttcttctgtttacaccaacctgattctttagaatctctcaatttccctcatttgcttaatccttcactcgtttccagaacttctccgagatctatccagcaagctgcttctaacgccggcatggccattgacgccggaatcgtccacagtaccagcgtgaactctggatgcggcgatacgacgacgtattacgagaatggagctgatcaagtggagccgttgaatatttcagtgtatgattatctgggcggccacgatcacgtttgatttatctcgacggtcatgatcacgtttgatcttcttttgagtaagattttgtaccataatcaaaacaggtgtggtgctaaaatcttactcaaaacaagattaggtaccacagagaaacaatcaaatggttgtgaatatacattataaggttgattaatgtttgtttcactgatttagtgaagtttggtccattgtatacaaatctattcaagaaacctagcgcgagatcatgtttcgtgattgaagattgagatttttaagtattcgtaatatttttgtaaaatacaaatatgtttctgatc

SEQ ID NO: 296 - protein, 144 aa, Arabidopsis thaliana
  misc_feature (1)..(144): Ceres CLONE ID no. 26867
  misc_feature (1)..(144): Also Known As Ceres CDNA ID no. 23390265
  misc_feature (1)..(144): Also Known As Ceres GEMINI ID no. 535B8
  misc_feature (12)..(77): Pfam Name: AP2 Pfam Description: AP2 domain
MDYRESTGESQSKYKGIRRRKWGKWVSEIRVPGTRDRLWLGSFSTAEGAAVAHDVAFFCLHQPDSLESLNFPHLLNPSLVSRTSPRSIQQAASNAGMAIDAGIVHSTSVNSGCGDTTTYYENGADQVEPLNISVYDYLGGHDHV

SEQ ID NO: 297 - DNA, 909 bp, Zea mays
  misc_feature (1)..(909): Ceres CLONE ID no. 272716
  misc_feature (1)..(909): Also Known As Ceres CDNA ID no. 23748760
  misc_feature (1)..(909): Also Known As Ceres GEMINI ID no. 536A11
accaaagcaaaccgaagccgcactctaccgcgctcctcccgaaccacagctatgctcgcccaccgcctcctcctcctcctcgccgtcgccgcggcgagcggcaccgccttcgctaagccgacggcgtacgaagccctcgctgactacgacttcccgccggggatcctccccaagggcgtggtcgcctacacgctcgacaacgccacgggcgccttcacggccacgctcgacgcctccgcgtccggcagcgggtcctccgtctgcgagttctccatccagggctcctactcgctccgctaccagaccaagatcaccggaaagatcgcccccgaccacctcaccgacctcgagggcgtctccgtcaaggtcctcttcttctggctcaacatcgtcgaggtcacccggcgcggcgacaacctcgagttctccgtcggcatcgtctccgcggacttcgggattgaaaacttcctcgagtgccccacctgtggctgcgggttcgactgcaacaacctgctcatgctgcagaagcccggcgccgccaccgccaagctgcgcctgcggggtgccttctagaactccacttctgcagatttggtgactgctgctgtaagctgcctcgactagtagtgctgtatgtctagtagatgtgggttaataaagagggcaaacttgaaagatcccagcttttagatgtgggatggggtaaccaagttcaggactcgatgtcatgtttcaccaattgtttcagacagttctaggaacagtcagagaagcaattaagacctttcaaatattttaatttatacgtctctatggaaattgtcttatttccattgagatgtttgcccctcatgtgaattagtttgtgaagtggtgatagttgaatcccatggatatggatggttgcct

SEQ ID NO: 298 - protein, 173 aa, Zea mays
  misc_feature (1)..(173): Ceres CLONE ID no. 272716
  misc_feature (1)..(173): Also Known As Ceres CDNA ID no. 23748760
  misc_feature (1)..(173): Also Known As Ceres GEMINI ID no. 536A11
  misc_feature (22)..(151): Pfam Name: DUF538 Pfam Description: Protein of unknown function, DUF538
MLAHRLLLLLAVAAASGTAFAKPTAYEALADYDFPPGILPKGVVAYTLDNATGAFTATLDASASGSGSSVCEFSIQGSYSLRYQTKITGKIAPDHLTDLEGVSVKVLFFWLNIVEVTRRGDNLEFSVGIVSADFGIENFLECPTCGCGFDCNNLLMLQKPGAATAKLRLRGAF

SEQ ID NO: 299 - protein, 164 aa, Triticum aestivum
  misc_feature (1)..(164): Ceres CLONE ID no. 678281
  misc_feature (1)..(164): Functional Homolog of  Ceres CLONE ID no. 272716 at SEQ ID NO. 298 with e-value of 4.10E-55 and percent identity of 75.7
MKSAMLPLLLLLAVAGPAAAKPTAYEALAAFDFPPGIIPKGVVSYTLDNATGDFTAHINSSSTCEFSIQGSYSLRYKPDISGRISVDRLTNLQGVTVKVLFFWLNIVEVTRSGDQLGFSVGIASADFGLDNFLESPTCGCGFDCNDLLLPQSTAEPSLRLRGAF

SEQ ID NO: 300 - protein, 182 aa, Oryza sativa subsp. japonica
  misc_feature (1)..(182): Public GI No. 54287657
  misc_feature (1)..(182): Functional Homolog of  Ceres CLONE ID no. 272716 at SEQ ID NO. 298 with e-value of 3.80E-52 and percent identity of 68.8
MPRLHLLLLAVLAVAAAAAEAAAEKKPTAYEVLESYDFPVGILPKGVTSYTLEATTGDFTATLDTGDDDDSSSSTCEFAIEGSYSLRYQRAITGRIATGHLTDLRGVAVKVLFFWLNIVEVTRRGDRLEFSVGIASADFTVDNFLESPQCGCGFDCDDDGISSSSSLPPPLEPSLLRLRGAF

SEQ ID NO: 301 - DNA, 1192 bp, Arabidopsis thaliana
  misc_feature (1)..(1192): Ceres CLONE ID no. 27793
  misc_feature (1)..(1192): Also Known As Ceres CDNA ID no. 23373749
  misc_feature (1)..(1192): Also Known As Ceres GEMINI ID no. 535D2
aaataaaacaataaacagtcgaaattctccggcgaagatgagaaccggaaaaagaaatcaagaggaagaagattacggagaagaagactttaactctaaacgtgaaggtccttcttccaacactactgttcatagcaacagagattcaaaggaaaatgataaagctagtgcgatacgttctaaacattcggtcactgagcaacgtagaagaagcaaaatcaatgaaagatttcagatattgagagaactaattcccaacagtgaacaaaaacgtgacactgcttcattccttttagaggtgatagattatgttcagtatttacaagagaaggtgcaaaagtatgaaggatcgtatccaggttggagtcaggaaccaacaaagttgacgccatggaggaataatcattggcgagttcaaagtttggggaaccacccagtagctataaataatggatctggtccagggataccttttcctggaaagtttgaagacaacactgtgacttcgacacctgcaattattgcagaaccgcaaatcccgattgaatctgacaaagcaagagctataaccggcatatcgattgaaagtcaacctgagttagacgacaaaagattaccaccactacaaccaattcttccaatggtacaaggcgaacaagctaatgaatgtcctgcaactagtgatgggctaggccaaagtaatgacctggttattgaaggtggaaccattagcatctctagtgcctactcgcatgagttattgagctcattaacacaagcactccagaatgcaggcattgatctgtcgcaagcaaagctttctgtgcagatcgatcttgggaagcgagccaatcaaggtctaactcatgaagagccatcaagtaagaatccattatcatatgatacgcaaggaagggattcaagcgttgaggaagaatctgaacattctcacaagcggatgaaaacactgtgacatttctctctcaggctccacggctctggaatatataaatgtattgacagattccttgtatcgtgtacattgttcggcttctaggggttcctatagtactcgttaagataaactttggttagtagattctgcgtttttttgtggttctgagtttgtatcatcttctgcatcattcatgtaacctatcaaatatgatctcttgtggtttcaagttattgc

SEQ ID NO: 302 - protein, 311 aa, Arabidopsis thaliana
  misc_feature (1)..(311): Ceres CLONE ID no. 27793
  misc_feature (1)..(311): Also Known As Ceres CDNA ID no. 23373749
  misc_feature (1)..(311): Also Known As Ceres GEMINI ID no. 535D2
  misc_feature (46)..(96): Pfam Name: HLH Pfam Description: Helix-loop-helix DNA-binding domain
MRTGKRNQEEEDYGEEDFNSKREGPSSNTTVHSNRDSKENDKASAIRSKHSVTEQRRRSKINERFQILRELIPNSEQKRDTASFLLEVIDYVQYLQEKVQKYEGSYPGWSQEPTKLTPWRNNHWRVQSLGNHPVAINNGSGPGIPFPGKFEDNTVTSTPAIIAEPQIPIESDKARAITGISIESQPELDDKRLPPLQPILPMVQGEQANECPATSDGLGQSNDLVIEGGTISISSAYSHELLSSLTQALQNAGIDLSQAKLSVQIDLGKRANQGLTHEEPSSKNPLSYDTQGRDSSVEEESEHSHKRMKTL

SEQ ID NO: 303 - protein, 336 aa, Glycine max
  misc_feature (1)..(336): Ceres CLONE ID no. 522644
  misc_feature (1)..(336): Functional Homolog of  Ceres CLONE ID no. 27793 at SEQ ID NO. 302 with e-value of 4.69E-86 and percent identity of 60.9
MRAGKGSQEEDEYEEEEFGSSKKQGTSSAPNTNKADGKAIDKASAIRSKHSVTEQRRRSKINERFQILRDLIPHSDQKRDTASFLLEVIEYVQYLQEKVQKYEGSYQGWGQEPSKLMPWRNSHWRVQSFAGQPTAVKNGLGPVSPFPGKFDESNVSISPTMLNGSQNTIDPDQSRDIVNKTAERQPDLVSKGIPLPLAMHANMSVPVRSDGVLAHPLQGTVSNAQSTECPTTSEPQNQQDELSVEGGTISISSAYSQGLLNNLTQALQSAGLDLSQASISVQINLGKRANKGLNCGTSSLKHHDNPSSNNQTIAHFRDAGSGEDSDQAQKRMKTYK

SEQ ID NO: 304 - DNA, 1590 bp, Zea mays
  misc_feature (1)..(1590): Ceres CLONE ID no. 283597
  misc_feature (1)..(1590): Also Known As Ceres CDNA ID no. 23758447
  misc_feature (1)..(1590): Also Known As Ceres GEMINI ID no. 555E3
aggcaggcaggcaccgcacgaggcctccatttggaccaccgggaccagaacccgatcgggcacggcggagaacgcgacgaagcataaaataagccatcacaactgcatttaaagcaaggcttcccactgagccgaaggtcctgagttcgacacagtctctcttcaaaaaatacaggggtacccaggctctaataatttgtacaaaaccgatggaaacttctaaatctcctcaatcgtcaaagaacagtcatattgtggtgccttctgatagtaatggcccccgatttgacaatgatggtttttcttcagaagctgcatcaaatcaaatggtcgttttcaactctgaagcaggagataaagagcaagatgaactgggggaaaaccgtttgcagaagtcaatcataacaaggggaatatcgccatctattggagcattcactgtccaatgtgctaaatgttttaaatggaggcttattccaacgaaagagaagtatgaagaaattcgtgaacgtattatagaggaaccttttgtatgcaaaagagctcgtgaatggagacctgatgtaacatgcaatgacccagaagatatatctcaggatggtagcaggctttgggctattgacaaacccaatattgcacaaccccctcgcggatgggaaaggcagattaggataagaggtgaagggggtaccaaatttgctgatgtatactatacctctcctactggaaggaaacttaggtctctggttgaagtcgataggttcctccaagagaatccggagtatggtgctcagggtgtaactttagctcagttttcgttccagatacctagacctctacggcaggactatgtgaaaaagaaaccgaagttgataaatccaagtgatgaagcaagtatgattgcctctaagtcttttcaaccagaagaagtgaaacccatagcctgggcagttgctacaaaacacgagggcgatgccagtgaagaagcttctctcaccgatgaggcacctacatcagaagtcatgctagcccggaagagaaaagcaggaagctctttgtcgatagagccaaaccatctctctgatgaacttgaaccaaagctggaggatgcttagaacggggagacgtctaccttataagtaaaagttagcagcatcgtgatgccaactgccccctatcatggttttattggccctctgcttgtttctcatttccctttggagccagtttctctgttttgcgaggtcacacaagccttatttgtagtattacaacacagaagctggctgacccaaaatccgacactctgggggcagcaacttaacaaaatgtttgtacgagggtttagagccccacggtgcttctttggataagtatgtttattaccttgtacttagctaggaacctgcttatatgtaagatctttgtgtacgacggagaattgtcacagcggcataattctggtgcatcttggatttaatctcctgttctttgttagaccggccagtaggcagtagcaaaggttttgaaatgtctcaagttatataactactgtggtattgctagtgtaattctctgagcatgtttttt

SEQ ID NO: 305 - protein, 301 aa, Zea mays
  misc_feature (1)..(301): Ceres CLONE ID no. 283597
  misc_feature (1)..(301): Also Known As Ceres CDNA ID no. 23758447
  misc_feature (1)..(301): Also Known As Ceres GEMINI ID no. 555E3
  misc_feature (135)..(212): Pfam Name: MBD Pfam Description: Methyl-CpG binding domain
  misc_feature (75)..(128): Pfam Name: zf-CW Pfam Description: CW-type Zinc Finger
METSKSPQSSKNSHIVVPSDSNGPRFDNDGFSSEAASNQMVVFNSEAGDKEQDELGENRLQKSIITRGISPSIGAFTVQCAKCFKWRLIPTKEKYEEIRERIIEEPFVCKRAREWRPDVTCNDPEDISQDGSRLWAIDKPNIAQPPRGWERQIRIRGEGGTKFADVYYTSPTGRKLRSLVEVDRFLQENPEYGAQGVTLAQFSFQIPRPLRQDYVKKKPKLINPSDEASMIASKSFQPEEVKPIAWAVATKHEGDASEEASLTDEAPTSEVMLARKRKAGSSLSIEPNHLSDELEPKLEDA

SEQ ID NO: 306 - protein, 272 aa, Arabidopsis thaliana
  misc_feature (1)..(272): Ceres CLONE ID no. 40501
  misc_feature (1)..(272): Also Known As Ceres CDNA ID no. 23427553
  misc_feature (1)..(272): Also Known As Ceres GEMINI ID no. 531H6
  misc_feature (1)..(272): Functional Homolog of  Ceres CLONE ID no. 283597 at SEQ ID NO. 305 with e-value of 4.59E-63 and percent identity of 50.1
MSMSQSRAVQRSSSPNEDRGENQLVVYDLKGNDDTEEEVLPVQSQPLSSRTQCPSIGAFTVQCASCFKWRLMPSMQKYEEIREQLLENPFFCDTAREWKPDISCDVPADIYQDGTRLWAIDKPNISRPPAGWQRLLRIRGEGGTRFADVYYVAPSGKKLRSTVEVQKYLNDNSEYIGEGVKLSQFSFQIPKPLQDDYVRKRPARLLDSIDNTNTPVAKEANPLAWISPDDHISLQLGTPTESGLNNSHYQPSKKKKTSTLSIFGSNDELADR

SEQ ID NO: 307 - protein, 297 aa, Zea mays
  misc_feature (1)..(297): Ceres CLONE ID no. 407007
  misc_feature (1)..(297): Functional Homolog of  Ceres CLONE ID no. 283597 at SEQ ID NO. 305 with e-value of 4.90E-123 and percent identity of 90.6
MESSKSPQSSKNSRIVVPSDSNRSRFDNDGFSSETASNQMVVFNSEAADELGENRLQKSVITKGISPSIGAFTVQCAKCFKWRLIPTKEKYEEIRERIIQEPFVCKRAREWRPDITCNDPEDISQDGSRLWAIDKPNIAQPPHGWERQIRIRGEGGTKFADVYYTSPTGRKLRSLVEVDRFLQENPEHVAQGVTLAQFSFQIPRPLRQDYVKKKPKLINASDEASTITSKSSEPEEVNPIAWAVPTKHEGDASEEASFADETLASEVVLTRKRKIGSSLSVEPNHLSDELEPKLEDA

SEQ ID NO: 308 - DNA, 1164 bp, Zea mays
  misc_feature (1)..(1164): Ceres CLONE ID no. 286402
  misc_feature (1)..(1164): Also Known As Ceres CDNA ID no. 23779979
  misc_feature (1)..(1164): Also Known As Ceres GEMINI ID no. 538H2
gcacgagaccattacctagaacatcctaatcgaaaagaaacggcggccgaggccgcaagcttctcactggccgcaagcaaaccgaacgaacccaaccgaagcgagagctgagcaaggcagaggcggcgtgaccggcgatggagcggctgcagcggatctttggcgcctccggcatggggcagccgccgacggactcgccgctgctcgattcctccgagcaggtctacatctcctccctagcgcttctcaagatgctcaagcacgggagggctggggtgcccatggaggtcatgggcctcatgctcggcgagttcgtcgacgactacaccgtcagggtcgtcgacgtcttcgccatgccgcagagcgggactggtgtcagcgtcgaggccgtagaccacgtcttccagacaaacatgcttgacatgcttaagcagaccggcaggccagaaatggttgtaggttggtatcactcacatcctggcttcggatgctggctatcaggcgtcgatatcaatactcagcagagttttgaagctttgaaccccagagccgttgctgttgtgatagaccccatccagagtgtgaaggggaaggtggttattgatgcattccgcctcattaatcctcagaccatgatgcttggccaggagccacgtcagacaacatcaaatgttgggcacctaaataagccatctattcaggctcttatccatgggctgaatagacactactactcaattgcaatcaattaccggaaaaatgagcttgaggagaaaatgctgttgaacttgcacaaaaagaaatggaccgatgggctaattttgaagaggtttgacactcactcgaaaaccaacgagcagactgtccaggaaatgctaaacctagccatcaagtacaacaaggcagtgcaggaggaggacgaactgcctcctgagaaacttgcgatagcaaatgtgggtcggcaagatgcaaaaaagcatttggaagagcatgtgttgtagttagatgttgctggtttctctgtcggcgctgctctgcttctgtaggaactgcgtcatgtaacctagcaaggacttgtttatttgtgaatcatcaacactttgttgttgatcacttatgttccaaattctgagtttgacgctggagcatgcctcatttgttgcc

SEQ ID NO: 309 - protein, 287 aa, Zea mays
  misc_feature (1)..(287): Ceres CLONE ID no. 286402
  misc_feature (1)..(287): Also Known As Ceres CDNA ID no. 23779979
  misc_feature (1)..(287): Also Known As Ceres GEMINI ID no. 538H2
  misc_feature (24)..(137): Pfam Name: Mov34 Pfam Description: Mov34/MPN/PAD-1 family
MERLQRIFGASGMGQPPTDSPLLDSSEQVYISSLALLKMLKHGRAGVPMEVMGLMLGEFVDDYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLILKRFDTHSKTNEQTVQEMLNLAIKYNKAVQEEDELPPEKLAIANVGRQDAKKHLEEHVL

SEQ ID NO: 310 - protein, 308 aa, Arabidopsis thaliana
  misc_feature (1)..(308): Ceres CLONE ID no. 23276
  misc_feature (1)..(308): Functional Homolog of  Ceres CLONE ID no. 286402 at SEQ ID NO. 309 with e-value of 0.0 and percent identity of 92.6
MERLQRIFGAGGGLGHASPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRSINPQTIMLGHEPRQTTSNLGHLNKPSIQALIHGLNRHYYSIAINYRKNELEEKMLLNLHKKKWTDGLTLRRFDTHSKTNEQTVQEMLSLAAKYNKAVQEEDELSPEKLAIVNVGRQDAKKHLEEHVSNLMSSNIVQTLGTMLDTVVF

SEQ ID NO: 311 - DNA, 1622 bp, Arabidopsis thaliana
  misc_feature (1)..(1622): Ceres CLONE ID no. 29310
  misc_feature (1)..(1622): Also Known As Ceres CDNA ID no. 24418089
  misc_feature (1)..(1622): Also Known As Ceres GEMINI ID no. 533E12
aaaaaaactctttcggatattccaccagtctctcgcaatcttcgctcttctcttagctctctctctctcaacgcggttcagatccgagtttgggagattcaagctccctgaaaaaagccctttactctcgcttaccaactttgctccagcatggcaggatctgcaccagaaggcacacagtttgatgcacgtcagtttgaccagaaactcaatgaagtacttgagggacaagatgagttcttcacatcctatgatgatgttcatgagagctttgatgccatgggtcttcaagagaaccttctcaggggtatttatgcttatggttttgagaagccttctgctattcagcaaagaggaatcgtccccttctgtaagggtcttgatgtgattcaacaggctcagtctggtactgggaaaacagcaactttctgctctggtgtcttgcagcagctggacttctcccttatccagtgtcaggctttggttctagctccaactagagagcttgctcagcaaattgagaaggtcatgagggcccttggtgattaccttggtgtcaaggttcacgcctgtgttggtggaaccagtgtccgtgaggatcagcgcatcctccaagctggtgtccatgttgttgttggaactccagggcgtgtctttgacatgttgaagaggcagtctcttcgtgctgacaacatcaagatgtttgttctcgatgaagctgatgaaatgctctcccgtggtttcaaggaccagatctatgacatattccagcttcttccaccaaagatccaagttggtgtgttctccgcaacaatgccaccagaagctcttgagatcacaaggaagttcatgagcaagccagtgagaatcttggtgaagcgtgatgagcttacccttgaaggtatcaagcagttctacgtcaacgttgagaaagaagagtggaagctcgagacactctgtgatctctacgagactcttgccatcactcagagtgtcatcttcgtgaacaccaggcgtaagggtgattggctcacagacaaaatgagaagccgtgaccacacagtctctgcaactcacggagacatggaccagaacaccagggacatcatcatgagagagttcaggtctggttcctcccgtgttctcatcaccactgacctcttagctcgtggtattgatgtccaacaagtctccctggttatcaacttcgatctcccaactcagccagagaactaccttcaccgtatcggaagaagtggaaggttcgggagaaagggtgttgcgatcaatttcgtgacccgtgatgatgagaggatgctgtttgatattcagaaattctacaatgtggttgtcgaagagctgccttcgaacgtggccgatctgctgtgaagggagaaaagaagtcggttctgttgctgtgtttgctctgccgtactagtatcaccggagaagaaaggttttcttgttttgcaaggcattctttgatctgattttgacccgtcgtctatcagcgatttacatttcttaaattttcttagttgttgttctctcctctctctcccagctacgaacatatctctctcttcttgaccatttttaagtttaagtcatatggagtatct

SEQ ID NO: 312 - protein, 412 aa, Arabidopsis thaliana
  misc_feature (1)..(412): Ceres CLONE ID no. 29310
  misc_feature (1)..(412): Also Known As Ceres CDNA ID no. 24418089
  misc_feature (1)..(412): Also Known As Ceres GEMINI ID no. 533E12
  misc_feature (297)..(373): Pfam Name: Helicase_C Pfam Description: Helicase conserved C-terminal domain
  misc_feature (62)..(229): Pfam Name: DEAD Pfam Description: DEAD/DEAH box helicase
MAGSAPEGTQFDARQFDQKLNEVLEGQDEFFTSYDDVHESFDAMGLQENLLRGIYAYGFEKPSAIQQRGIVPFCKGLDVIQQAQSGTGKTATFCSGVLQQLDFSLIQCQALVLAPTRELAQQIEKVMRALGDYLGVKVHACVGGTSVREDQRILQAGVHVVVGTPGRVFDMLKRQSLRADNIKMFVLDEADEMLSRGFKDQIYDIFQLLPPKIQVGVFSATMPPEALEITRKFMSKPVRILVKRDELTLEGIKQFYVNVEKEEWKLETLCDLYETLAITQSVIFVNTRRKGDWLTDKMRSRDHTVSATHGDMDQNTRDIIMREFRSGSSRVLITTDLLARGIDVQQVSLVINFDLPTQPENYLHRIGRSGRFGRKGVAINFVTRDDERMLFDIQKFYNVVVEELPSNVADLL

SEQ ID NO: 313 - protein, 412 aa, Arabidopsis thaliana
  misc_feature (1)..(412): Ceres CLONE ID no. 3997
  misc_feature (1)..(412): Also Known As Ceres CDNA ID no. 24418108
  misc_feature (1)..(412): Also Known As Ceres GEMINI ID no. 533D10
  misc_feature (1)..(412): Functional Homolog of  Ceres CLONE ID no. 29310 at SEQ ID NO. 312 with e-value of 0.0 and percent identity of 96.3
MAGSAPEGTQFDTRQFDQRLNEVLDGQDEFFTSYDEVHESFDAMGLQENLLRGIYAYGFEKPSAIQQRGIVPFCKGLDVIQQAQSGTGKTATFCSGVLQQLDYALLQCQALVLAPTRELAQQIEKVMRALGDYQGVKVHACVGGTSVREDQRILQAGVHVVVGTPGRVFDMLRRQSLRPDCIKMFVLDEADEMLSRGFKDQIYDIFQLLPPKIQVGVFSATMPPEALEITRKFMSKPVRILVKRDELTLEGIKQFYVNVEKEDWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTLDDQRMLFDIQKFYNVVVEELPSNVADLL

SEQ ID NO: 314 - protein, 413 aa, Nicotiana plumbaginifolia
  misc_feature (1)..(413): Public GI No. 19697
  misc_feature (1)..(413): Functional Homolog of  Ceres CLONE ID no. 29310 at SEQ ID NO. 312 with e-value of 0.0 and percent identity of 93.6
MAGSAPEGSQFDARQFDAKMTELLGTEQEEFFTSYDEVYDSFDAMGLQENLLRGIYAYGFEKPSAIQQRGIVPFCKGLDVIQQAQSGTGKTATFCSGVLQQLDYSLVECQALVLAPTRELAQQIEKVMRALGDYLGVKVHACVGGTSVREDQRILQSGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINSVTKDDERMLFDIQKFYNVVIEELPANVADLL

SEQ ID NO: 315 - protein, 413 aa, Nicotiana tabacum
  misc_feature (1)..(413): Public GI No. 2119938
  misc_feature (1)..(413): Functional Homolog of  Ceres CLONE ID no. 29310 at SEQ ID NO. 312 with e-value of 0.0 and percent identity of 93.4
MAGLAPEGSQFDARQYDAKMTELLGTEQEEFFTSYDEVYDSFDAMGLQENLLRGIYAYGFEKPSAIQQRGIVPFCKGLDVIQQAQSGTGKTATFCSGVLQQLDYSLVECQALVLAPTRELAQQIEKVMRALGDYLGVKVHACVGGTSVREDQRILQSGVHVVVGTPGRVFDMLRRQSLRPDHIKMFVLDEADEMLSRGFKDQIYDIFQLLPPKIQVGVFSATMPPEALEITRKFMSKPVRILVKRDEVTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVIEELPANVADLL

SEQ ID NO: 316 - protein, 413 aa, Nicotiana tabacum
  misc_feature (1)..(413): Public GI No. 485943
  misc_feature (1)..(413): Functional Homolog of  Ceres CLONE ID no. 29310 at SEQ ID NO. 312 with e-value of 0.0 and percent identity of 93.2
MAGLAPEGSQFDARQYDAKMTELLGTEQEEFFTSYDEVYDSFDAMGLQENLLRGIYAYGFEKPSAIQQRGIVPFCKGLDVIQQAQSGTGKTATFCSGVLQQLDYSLVECQALVLAPTRELAQQIEKVMRALGDYLGVKVHACVGGTSVREDQRILQSGVHVVVGTPGRVFDMLRRQSLRPDHIKMFVLDEADEMLSRGFKDQIYDIFQLLPPKIQVGVFSATMPPEALEITRKFMSKPVRILVKRDDVTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVIEELPANVADLL

SEQ ID NO: 317 - protein, 413 aa, Helianthus annuus
  misc_feature (1)..(413): Public GI No. 38564733
  misc_feature (1)..(413): Functional Homolog of  Ceres CLONE ID no. 29310 at SEQ ID NO. 312 with e-value of 0.0 and percent identity of 92.9
MAGVAPEGSQFDARQFDSKMNDLLSADGQDFFTSYDEVYDSFDAMGLQENLLRGIYAYGFEKPSAIQQRGIVPFTKGLDVIQQAQSGTGKTATFCSGILQQLDYNVVECQALVLAPTRELAQQIEKVMRALGDYLGVKVHACVGGTSVREDQRILSAGVHVVVGTPGRVFDMLRRQSLRSDNIKMFVLDEADEMLSRGFKDQIYDIFQLLPSKVQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTLDDEKMLGDIQKFYNVVVEELPSNVADLI

SEQ ID NO: 318 - DNA, 712 bp, Arabidopsis thaliana
  misc_feature (1)..(712): Ceres CLONE ID no. 29637
  misc_feature (1)..(712): Also Known As Ceres CDNA ID no. 23366647
  misc_feature (1)..(712): Also Known As Ceres GEMINI ID no. 553C3
aacaatggcggcagttcaacagcaacaagcgatgcagaagaacactttatacgtaggaggtttagctgatgaagttaacgaatcgatccttcacgccgcgtttatacctttcggcgatatcaaagacgtgaagacgccgttggaccaagcgaatcagaagcatagatccttcggattcgttacttttcttgagagagaagacgcttctgctgctatggataatatggacggtgctgagctttatggtcgtgtcctcactgttaattatgctctccctgagaaaattaagggtggtgaacagggttgggctgctcatccactttgggcagatgcagacacatggtttgagaggcagcaacaggagaaggagattctgaagatgcaagctgagaacaaggctgccatggagactgctgaggagcttcacaggaagaaattggcggaagatcgacaaggagagatggaggaagatacagataccaaagatgatcctatggccagagcagaggctgatgctctaagtcacggcgatgcctaatgaaagtaagcgttaccggattctcttatgcaccttgtcctgtaggataacaagtatgttttcgcctgagtgtgtaacactgtcactatcacctcatagagtttttgaggttagattgtttcttgaggttgattaccatgttattgctatagttaatagattaggtagtttggc

SEQ ID NO: 319 - protein, 177 aa, Arabidopsis thaliana
  misc_feature (1)..(177): Ceres CLONE ID no. 29637
  misc_feature (1)..(177): Also Known As Ceres CDNA ID no. 23366647
  misc_feature (1)..(177): Also Known As Ceres GEMINI ID no. 553C3
  misc_feature (15)..(86): Pfam Name: RRM_1 Pfam Description: RNA recognition motif. ( a.k.a. RRM, RBD, or RNP domain)
MAAVQQQQAMQKNTLYVGGLADEVNESILHAAFIPFGDIKDVKTPLDQANQKHRSFGFVTFLEREDASAAMDNMDGAELYGRVLTVNYALPEKIKGGEQGWAAHPLWADADTWFERQQQEKEILKMQAENKAAMETAEELHRKKLAEDRQGEMEEDTDTKDDPMARAEADALSHGDA

SEQ ID NO: 320 - protein, 171 aa, Oryza sativa subsp. japonica
  misc_feature (1)..(171): Public GI No. 34896798
  misc_feature (1)..(171): Functional Homolog of  Ceres CLONE ID no. 29637 at SEQ ID NO. 319 with e-value of 8.79E-69 and percent identity of 78.7
MNQPVQKNTLYVGGLAEEVDEKILHAAFVPFGEIKDVKTPLDQATQKHRSFGFVTFLEREDAAAAMDNMDGAELFGRVLTVNYAFPERIKGGEQGWAAQPIWADADTWFERQQQEEEMQRLQAEQRAAMQAAEKLHREKLAAEKEGEKEEETDTNADPMAAAEAQALKQSS

SEQ ID NO: 321 - DNA, 1150 bp, Zea mays
  misc_feature (1)..(1150): Ceres CLONE ID no. 303140
  misc_feature (1)..(1150): Also Known As Ceres GEMINI ID no. 536B10
gcacgagaccattacctagaacatcctaatcgaaaaattttcctttccccttggcattcgctccactgcttctccggcgaattggatcggcggcgatccatcgtcgtcggatcgcaactcctgactagcttgttgctgcaggatcgtcatccgtcgcgcctgctgcttgggtttgttttccctgctcacggaaatggggatggagatagacatggagacgtatcccaatcttaatacttccccctcggccgccactgcctcaggcgacgccaaggcctgcgccaactgccacaccaccaagacgtcgctctggcgcggaggaccggagggccccaagtccctctgcaacgcctgcggcatccgctaccgcaagaggaggcaggcgatcggtctcgacgcaggagcggccgccgccgccaactcacagcaagatctgcagcagccaaagaagaaggccgccgtcgatccgcagcagcaggaccagcatcagctgagaaagaagacaacagcggtcgctaatccacagcaggatcggcatcagccgagaaagagagcagctgccgctgccgctgccaccgatccacagcacaccagcatcaccaagaaagacacggacaagaaggatcagcaagtcaccgtggatctccacgtggtggggttcggcaaggaggcgacgttcaagcagcgccgccggatgcgccacaataagtgcatgagcgaggaggagagggccgctgttcttcttatggcgctctcatcgggcgtcatatatgcatcatgagaagtccgctctcctgattccaactgttccgttgcagatggagatatagatccgccttcccttccattcatcatccccctgcttcctatccctatcttcctcttcctcctaggtcatccatcagtagtactgtagtgataggtctagctagactctcatcaatcaatctatcgcttgactcatcagtcaatctatctctctatcttgaaaaattaatccatcctctatctctctctctctctctctctctctctcttttagtttttttgggcaagttagtagtagcaatagcgaagccggacaagacaaatccattcagtcatgtgatgtacttgctcagctgtgtaatgtagtataatgccgttatgc

SEQ ID NO: 322 - protein, 195 aa, Zea mays
  misc_feature (1)..(195): Ceres CLONE ID no. 303140
  misc_feature (1)..(195): Also Known As Ceres GEMINI ID no. 536B10
  misc_feature (29)..(64): Pfam Name: GATA Pfam Description: GATA zinc finger
MGMEIDMETYPNLNTSPSAATASGDAKACANCHTTKTSLWRGGPEGPKSLCNACGIRYRKRRQAIGLDAGAAAAANSQQDLQQPKKKAAVDPQQQDQHQLRKKTTAVANPQQDRHQPRKRAAAAAAATDPQHTSITKKDTDKKDQQVTVDLHVVGFGKEATFKQRRRMRHNKCMSEEERAAVLLMALSSGVIYAS

SEQ ID NO: 323 - DNA, 1353 bp, Zea mays
  misc_feature (1)..(1353): Ceres CLONE ID no. 304523
  misc_feature (1)..(1353): Also Known As Ceres CDNA ID no. 23761786
  misc_feature (1)..(1353): Also Known As Ceres GEMINI ID no. 538C4
ctcccgtccaggttcactccgccactccggccccctcatcttcttcccgtccccctcttcgttgcccccagatcccgcaaaccgcgaaaagaaaccgcatatcagcggacagcgggcgctgctcgttctcatcgcccccctctcgtctctcgcggagccgaccccgtccccattcggacctcagctagccaccaccaccatggcttcttcgaagaggagatttggtgctgccggcggcgcggacaagaaggatctattccatgtcgtccacaaggtgcccgccggcgacagcccgtacgtcgtagccaagcacctccagctcgtggagaagcaaccggatgtggcgatcgtgtggttctggaaggcaatcaactcaggggacagggtggacagcgccctgaaggacatggccatggtgatgaagcagcaggaccgttccgaggaggcaatcgaggccatcaggtccttcaggcacctctgctccaagcaggctcaggaatccctcgacaacctcctcattgacctctacaagaaatgcgggaaagttgaggagcagatcgagctcctgaaacagaagctcaagtcgatataccttggcgaggccttcaacgggaaggcgacgaagaaagcgcggtcccatggcaagaagtttcaggtctcgatccaacaagagacgtctcgtattctgggcaatcttggctgggcttacatgcagcagaacaacttcgaagccgccgagctggtgtaccgcaaggcgcaagctatcgagcccgatgccaacagggcgtgcaaccttgggctgtgcctgatcaagcagggcaggcacgaggaggcacggcaagcactcgaggacgtccgattgcgcagaatctatggatcagaagatgcaaaggtggttgcccgtgcggagcagcttctccgcgagctaaacccgttgcaatgcgtttcatcgccgttccaggttggcctcagcgtccatgaagggatcatgggtgaaccagacctagtagtgatgaacgagtggacgccgttcaggtcgaggaggctgcctgtgtttgaggagatagcaactttccgggaccaaatggcttgttgatgcattactttgcatggtttaatttatctgtcagtgtcacactcacatccctctagaagtttttgttcgtatactgggtgtgggggcgtgacggtgaggaatagagatcagtatatatcatatagctggggttgatgcaaagcgttgcctttaggatagtatttggttcatgttatatcactgtatggttcagatttcagtgaacaaatgttcgtgcgtgccctgatcttgtacaggatttacagttggctgttgtg

SEQ ID NO: 324 - protein, 298 aa, Zea mays
  misc_feature (1)..(298): Ceres CLONE ID no. 304523
  misc_feature (1)..(298): Also Known As Ceres CDNA ID no. 23761786
  misc_feature (1)..(298): Also Known As Ceres GEMINI ID no. 538C4
  misc_feature (193)..(218): Pfam Name: TPR_4 Pfam Description: Tetratricopeptide repeat
MASSKRRFGAAGGADKKDLFHVVHKVPAGDSPYVVAKHLQLVEKQPDVAIVWFWKAINSGDRVDSALKDMAMVMKQQDRSEEAIEAIRSFRHLCSKQAQESLDNLLIDLYKKCGKVEEQIELLKQKLKSIYLGEAFNGKATKKARSHGKKFQVSIQQETSRILGNLGWAYMQQNNFEAAELVYRKAQAIEPDANRACNLGLCLIKQGRHEEARQALEDVRLRRIYGSEDAKVVARAEQLLRELNPLQCVSSPFQVGLSVHEGIMGEPDLVVMNEWTPFRSRRLPVFEEIATFRDQMAC

SEQ ID NO: 325 - protein, 296 aa, Glycine max
  misc_feature (1)..(296): Ceres CLONE ID no. 481452
  misc_feature (1)..(296): Functional Homolog of  Ceres CLONE ID no. 304523 at SEQ ID NO. 324 with e-value of 2.89E-93 and percent identity of 65.0
MEGINVCKKSSKLGKKDDLYHVIHKVPYGDSPYVKAKHAQLVDKDPEAAIVLFWKAINAGDKVDSALKDMAVVMKQLDRSEEAIEAIKSFRGLCSKHSQESLDNVLLDLYKKCGKIEEQIELLKRKLRLIYQGEAFNGRTTRTARSHGKKFQVSIKQETARLLGNLGWAYMQKENYMMAEVVFKKAQMVDADANKACNLGLCLMRQCRYEEAYYILEEVLQGKHQGSDEIKSRKRAEELLEELNANLPQPEFMADLDLDDDFVKGIDDMLDAWNTNRSRRLPIFEEISSFRDQLAC

SEQ ID NO: 326 - protein, 299 aa, Oryza sativa subsp. japonica
  misc_feature (1)..(299): Public GI No. 52353366
  misc_feature (1)..(299): Functional Homolog of  Ceres CLONE ID no. 304523 at SEQ ID NO. 324 with e-value of 1.60E-126 and percent identity of 83.7
MASSSKRRGGAGGGGAEKKDLFHVVHKVPAGDSPYVRAKHLQLVDKDPETAIVWFWKAINSRDKVDSALKDMAVVMKQQDRAKEAIEAIRSFRHLCSRQAQESLDNLLIDLYKKCGKVDEQIDLLKQKLKMIYLGEAFNGKATKTARSHGKKFQVSIQQETSRILGNLGWAYMQQSNYSAAELVYRKAQSIEPDANRACNLGLCLIKQSRHDEARQVLHDVVLRRISGSEDDKVVARAKQLLHELEPVTHVTSPNNAGLSVSEEIMERLDLVLNEWTPFRSRRLPVFEEIATLRDQIAC

SEQ ID NO: 327 - DNA, 1198 bp, Zea mays
  misc_feature (1)..(1198): Ceres CLONE ID no. 306497
  misc_feature (1)..(1198): Also Known As Ceres CDNA ID no. 23765347
  misc_feature (1)..(1198): Also Known As Ceres GEMINI ID no. 552G5
agaagaaagctccaatctttctcgccctctcgcggttcggaggagggacccgggcgcaaagactaaagcgcaggtgagctccgggcggggaagatgttccccagcctgatccaccacgctagccacggccgacccgacgtcgccgtcgccgaggacgcaccacgcagtggctgcgggttagggctgcccgggcacggcggcgggcccagcgtggtgctcacggccgatcccaagcctaggctccgctggacggccgacctccacgaccgtttcgtcgatgccgtcgcccagctcggcgggcctgataaagcaacaccgaaagctatcatgaggacaatgggagtgaagggcctcaccctttttcacttgaaaagccatcttcagaaatacagattgggaagacagtctggaaaagagttaacggagcaatcaaaagatgcttcttaccttatggaagctcaaagtggaacaactttgtctcctagaggttctactccagatgtgaaagagagtcaagaagttaaagaagcactcagagcacaaatggaagtgcaacgaagattgcacgaacaagtggaggtccagaagcatatgcagatccgaatggaggcgaaccagaagtacatcgacacgatactagataaggcgttcaagatagtatctgagcaactgagtggcttcagcatatctgaccaagacctaccgattctcacctctgctagggccatgcttagccctgcagatcacttgagttcgtctgtcttcccccagctctccgtcagctccgttagccttcacaatcctggtcctggaggagggaaaggccttccgcatgttgccgacagccacgtgttctcccagaggccacctgaacaattcaagcgcaaatcacgttgagaagcattgctagctcgacgcagatgcatgacctgatcaagggcacactggaaaatcagaggaatttcgtctgacatgtgcacggtgcaatcgttcgcccatcctcccgtagcacatctgtgaaaatcaaggttatcttggtctatttcggtacatctagactgacctttattaatatctaatgtaatgcctaagtggactagataagtaattcgcttgttgtataaactgcccagctgtaggatccagttttaaagtcctgttccacgcacttaaaacttgggggccgtctcttgggcgg

SEQ ID NO: 328 - protein, 267 aa, Zea mays
  misc_feature (1)..(267): Ceres CLONE ID no. 306497
  misc_feature (1)..(267): Also Known As Ceres CDNA ID no. 23765347
  misc_feature (1)..(267): Also Known As Ceres GEMINI ID no. 552G5
  misc_feature (49)..(100): Pfam Name: Myb_DNA-binding Pfam Description: Myb-like DNA-binding domain
MFPSLIHHASHGRPDVAVAEDAPRSGCGLGLPGHGGGPSVVLTADPKPRLRWTADLHDRFVDAVAQLGGPDKATPKAIMRTMGVKGLTLFHLKSHLQKYRLGRQSGKELTEQSKDASYLMEAQSGTTLSPRGSTPDVKESQEVKEALRAQMEVQRRLHEQVEVQKHMQIRMEANQKYIDTILDKAFKIVSEQLSGFSISDQDLPILTSARAMLSPADHLSSSVFPQLSVSSVSLHNPGPGGGKGLPHVADSHVFSQRPPEQFKRKSR

SEQ ID NO: 329 - protein, 246 aa, Oryza sativa subsp. japonica
  misc_feature (1)..(246): Public GI No. 50944571
  misc_feature (1)..(246): Functional Homolog of  Ceres CLONE ID no. 306497 at SEQ ID NO. 328 with e-value of 2.29E-86 and percent identity of 76.7
MFPGLIHHHRLLDADVGGGGGGSSAGLVLTADPKPRLRWTADLHDRFVDAVAQLGGPDKATPKTIMRTMGVKGLTLFHLKSHLQKYRLGKQSGKEMAEQSKDASYILGAQSGTNLSPTVPTPDLKESQELKEALRAQMEVQRKLHEQVEVQRHVQIRMEAYQNYIDTLLEKACNIVSEQLNGFSISDHDLTSAGVMLSSSDTLSPSIFHQLSVSSISLHSPGGKSSPFAADADLFFQKAPEKRKSY

SEQ ID NO: 330 - DNA, 704 bp, Arabidopsis thaliana
  misc_feature (1)..(704): Ceres CLONE ID no. 31252
  misc_feature (1)..(704): Also Known As Ceres GEMINI ID no. 531H4
gatcgaatcataaaccaaacaaatctttcttttaaaagaagcggacacaaaccctaaccaccaaccctctccgtcgtcaaatttcccggcgaaagatgaaacgaattgttcgaatttcattcacagacatggaagcaaccgattcttcaagcagcgaagacgagtcaccaccgtcatcacgccgtcgaggtaagaagctagtcaaggaaatcgtaatcgatcattctgatcccccggaggtcggaaaaactcggttcaaaatcaggattccggcgagtttacttgctgcgaggaatacgacggcgaataagaagaagttccgtggcgtgaggcagagaccatgggggaagtgggcggctgagattagatgtggtagagttaaaggaagacctgaacgaatttggcttgggacttttgaaacagctgaagaagctgctcttgcttatgataacgctgcgattcagttgattggacctgatgcgccgactaattttggccgtcctgatgttgattctgcggtggtgaaaaagcaagattctgatgctagtggtggtgcttctgaagaagttgtttgattttcttgtttataactaactttgcaaggttacttttgtttatcatcatcttttgtaaatttgatcatcttgctctttgctttttaacttctcttgtacatgtttgaattataaaagttctaatttttc

SEQ ID NO: 331 - protein, 159 aa, Arabidopsis thaliana
  misc_feature (1)..(159): Ceres CLONE ID no. 31252
  misc_feature (1)..(159): Also Known As Ceres GEMINI ID no. 531H4
  misc_feature (73)..(139): Pfam Name: AP2 Pfam Description: AP2 domain
MKRIVRISFTDMEATDSSSSEDESPPSSRRRGKKLVKEIVIDHSDPPEVGKTRFKIRIPASLLAARNTTANKKKFRGVRQRPWGKWAAEIRCGRVKGRPERIWLGTFETAEEAALAYDNAAIQLIGPDAPTNFGRPDVDSAVVKKQDSDASGGASEEVV

SEQ ID NO: 332 - DNA, 756 bp, Zea mays
  misc_feature (1)..(756): Ceres CLONE ID no. 316638
  misc_feature (1)..(756): Also Known As Ceres CDNA ID no. 23767585
  misc_feature (1)..(756): Also Known As Ceres GEMINI ID no. 538E5
attccgttccgagagccaaaaactccactgctttcatcaactccggcgacttggagaagacgaagttccagaatccgatcggaagtttggtgctcgcgccttgacggattgatttcggtgcgccgatggggcaggcgttccgcaagctgttcgattccttcttcggcaccagcgagatgagggttgtgatgcttggtctggatgctgccggtaaaaccaccatattgtacaagctgcatatcggggaggttttgtcgactgttcccacgattggtttcaacgtcgagaaagttcaatacaagaatgtgatgtttactgtgtgggatgttggtggccaagaaaagttgagggtgactacgtccgcaaaggagatgagtttgggtatttctcctttggagggagtacagtgatatgcgtcttcgagaaggacgccatccaatttgacgctgatctcgtggcaaacagcgaaaggtcactggagaccaagtcccggatctgcagaaagtttcgctcggatgacagacagagctgtaaactgtgtgcaggttaacagtagcgtatatttgatactagcaactgccactggtaggcaatactattatcacataatccaagactacatgtatagtcaggctagaggagtctggtttacggcggtgggcgtgggcatgggcattggcccagctgtcatcggctgagagctcactgcatggctcggtggtttttgcaatgacgatactaaccgtgcagttgctc

SEQ ID NO: 333 - protein, 94 aa, Zea mays
  misc_feature (1)..(94): Ceres CLONE ID no. 316638
  misc_feature (1)..(94): Also Known As Ceres CDNA ID no. 23767585
  misc_feature (1)..(94): Also Known As Ceres GEMINI ID no. 538E5
  misc_feature (4)..(93): Pfam Name: Arf Pfam Description: ADP-ribosylation factor family
MGQAFRKLFDSFFGTSEMRVVMLGLDAAGKTTILYKLHIGEVLSTVPTIGFNVEKVQYKNVMFTVWDVGGQEKLRVTTSAKEMSLGISPLEGVQ

SEQ ID NO: 334 - DNA, 1006 bp, Arabidopsis thaliana
  misc_feature (1)..(1006): Ceres CLONE ID no. 31894
  misc_feature (1)..(1006): Also Known As Ceres CDNA ID no. 23358176
  misc_feature (1)..(1006): Also Known As Ceres GEMINI ID no. 535C8
aaattggggaagaaaatttacagtgttgaaattggttaaaccctgacactagcaccttcctcagtcgcatcaccaccatgtcagagcgcgaccgccgcgaacgagagagggatagggaccgtgaaccagaccgtgatagacgccgaggtagagacgaccgtgaccgtgaccgtgatcgagaccgggaaagagatagagagcgcgaccgtgaccgagggcttagaaacaaaaaatcccgatctcgtactccagaccaccacgctcgtgctcgccacgtgcgctctccggagaggtatcgctctcgttcccgctcgattgaccgtgaccgggaccgggaccgtcaacgacaccacaggcgcaggtctccttctccagatgctccgtcgcgaaaacggcctcgccagggttcagtagacgatgagaaagaaaggaatcgcaaaagagtagtgactgattccgttgacgagaatgcgcctactattactaagaagaaggataaacaaccaagtgatgctgctgataatggcggaggcgaagatgaagaaggaatggatgtgaatgagattgagatgatgaagatgttagggattcctactggatttgattccacaaaaggcaaaccagttgctggtgctgatgttagtggtattagagctgtaactaagcgtcagccaagacagtacatgaaccgtcgcggtggatttaaccgtcctctaccggccgagcgtaatcgctagtcttctcaaggtccctctaacgctgtcttgaacactagtcaaaaagatgagggctagagctgcatttcccagatagtagttactagttactccaattcttccccagactctgttctgatgtcttatagagaacaaacttgtactctctgaatttggttggaaacaactcgtgagttatttctttttcgagatttaaaaatgttaatgtttgtgtgtaatctcccggctctaactgtcagactatggttcatttgaaatcaggcttattc

SEQ ID NO: 335 - protein, 219 aa, Arabidopsis thaliana
  misc_feature (1)..(219): Ceres CLONE ID no. 31894
  misc_feature (1)..(219): Also Known As Ceres CDNA ID no. 23358176
  misc_feature (1)..(219): Also Known As Ceres GEMINI ID no. 535C8
MSERDRRERERDRDREPDRDRRRGRDDRDRDRDRDRERDRERDRDRGLRNKKSRSRTPDHHARARHVRSPERYRSRSRSIDRDRDRDRQRHHRRRSPSPDAPSRKRPRQGSVDDEKERNRKRVVTDSVDENAPTITKKKDKQPSDAADNGGGEDEEGMDVNEIEMMKMLGIPTGFDSTKGKPVAGADVSGIRAVTKRQPRQYMNRRGGFNRPLPAERNR

SEQ ID NO: 336 - protein, 182 aa, Glycine max
  misc_feature (1)..(182): Ceres CLONE ID no. 470947
  misc_feature (1)..(182): Functional Homolog of  Ceres CLONE ID no. 31894 at SEQ ID NO. 335 with e-value of 9.40E-49 and percent identity of 65.7
MTDRDRDRDRDRTRDRERERRRDKDDRDRDRDRARSKRSRSRSPDRGRSRHARSPSPSERSHRRRHHRTPSPDPPRKRHRRDSAEEDHKETKKAVSDFVDGIVKEQQQKENGDGGEGEAEGSEDELEIMKMFGIPTGFDSTKGKPVPGADVSGVRAVTKRQPRQYMNRRGGFNRPLPAERNR

SEQ ID NO: 337 - protein, 184 aa, Glycine max
  misc_feature (1)..(184): Ceres CLONE ID no. 1362529
  misc_feature (1)..(184): Functional Homolog of  Ceres CLONE ID no. 31894 at SEQ ID NO. 335 with e-value of 1.20E-48 and percent identity of 65.3
MTDRDRDRDRDRTRDRERERRRDKDDRDRDRDRARSKRSRSRSPDRGRSRHLRSPSPSERSHRRRHHRTPSPDPPRKRHRRDSTEEEHKETKKAVSDFVDGIVKEQQQKQQKDNGDGGGEAEGNEDELEMMKMFGIPTGFDSTKGKPVPGADVSGVRAVTKRQPAQYMNRRGGFNRPFAAEKNR

SEQ ID NO: 338 - protein, 195 aa, Triticum aestivum
  misc_feature (1)..(195): Ceres CLONE ID no. 696259
  misc_feature (1)..(195): Functional Homolog of  Ceres CLONE ID no. 31894 at SEQ ID NO. 335 with e-value of 2.59E-44 and percent identity of 63.8
MSDRRRDRERPRERGGYDQPRERDHDADRHRDRDRDVDRHRDRDRGQDKERDRDRDYRRARKRSRSRSPSADRDRARRRRSHSHSHPHRSRSPDAGRHKRRREGSPVADSKEDRKPDPPKAAEEAAAPVGDGDVDAEELEMMKMMGIPVGFDSTKGKYVPGADVSGVRAVTKRQPRQYMNRRGGFNRPLPPEVNR

SEQ ID NO: 339 - protein, 200 aa, Zea mays
  misc_feature (1)..(200): Ceres CLONE ID no. 425645
  misc_feature (1)..(200): Functional Homolog of  Ceres CLONE ID no. 31894 at SEQ ID NO. 335 with e-value of 1.79E-45 and percent identity of 62.2
MSDRRRDKEKPRDRDIDRHRDRDRDIDRHRDRDRDRDRDRDRDRDRERDHRRERERERKRSRSRSPSADRDRSHRRHSHSHRGRPSPSPDAGRHKRRREASPASADHHHKEDKKAADSHATPGGGDIAAAAAAVGDGDVNAEELEMMKMMGIPVGFDSTKGKHVPDADVSGVRAVTKRQPRQYMNRRGGFNRPLPPERNR

SEQ ID NO: 340 - DNA, 943 bp, Zea mays
  misc_feature (1)..(943): Ceres CLONE ID no. 319760
  misc_feature (1)..(943): Also Known As Ceres GEMINI ID no. 552A9
agctcgcctctcctctcattctctcgtgctctccacccgtttcccgcaaaaccctagctctgcgacatgcaccgcggcggcgatcgctccggcggcccctcgagcggcggagaccgctctggagcccggttccagcggggtccctcccgctggtctggcagcagcggcggcggattagggggtagcccgcccaatcgctactcctcccgcggcgcggcagatggaggtggtggagggggcggtggcgggaggttccacccttaccgtggttcttccgactattctagcggcggtggagggtacagaggcggtagtggcgttggtaacgacttcggcgaccagaggcaacgttacggcggcggcactagaggcggaggccgtggggatttccaagatcatgatagtagaagtaactatgtcaaactttttgtcggatctgttccgaggacagcgactgaagaagacgttcgtcctttatttgaggaacatggagatgttcttgaagttgcyctaattaaggataggaagaccggtgaacaacaaggtatgctatgtctttgtttttcttgtattatcacaattgagtatctcttttgttttcaggtttctgagaggttataggagcaacaaggttgcatcttctctcagttagattggcggttgttgattttcatttcctgcgcttccattctgtccgtctcctgtggattcagtagaagactagaatggacgcgactaactgcccgccgattactggaacctaactagccacaacttcactgctacacaaggcagcaaatttggtaccaacagctgtgtttagatgatattgaccttctggatgtcctgtagttctagagcaatgagcttgtagtttcacctttgcatctgtgtgccttgattttgttgcaagaacttatataatcttataatgaattaatac

SEQ ID NO: 341 - protein, 184 aa, Zea mays
  misc_feature (1)..(184): Ceres CLONE ID no. 319760
  misc_feature (1)..(184): Also Known As Ceres GEMINI ID no. 552A9
  misc_feature (120)..(156): Pfam Name: RRM_1 Pfam Description: RNA recognition motif. ( a.k.a. RRM, RBD, or RNP domain)
MHRGGDRSGGPSSGGDRSGARFQRGPSRWSGSSGGGLGGSPPNRYSSRGAADGGGGGGGGGRFHPYRGSSDYSSGGGGYRGGSGVGNDFGDQRQRYGGGTRGGGRGDFQDHDSRSNYVKLFVGSVPRTATEEDVRPLFEEHGDVLEVALIKDRKTGEQQGMLCLCFSCIITIEYLFCFQVSERL

SEQ ID NO: 342 - protein, 169 aa, Triticum aestivum
  misc_feature (1)..(169): Ceres CLONE ID no. 819279
  misc_feature (1)..(169): Functional Homolog of  Ceres CLONE ID no. 319760 at SEQ ID NO. 341 with e-value of 5.59E-58 and percent identity of 78.2
MHRGSDRSGDPSGPAGGARSGADGRFARGPSRWSGGGGGSPPPHRSSRGGSSDGGGGGGGGGRFHPYRAPSEYVVGGGGTGGYRGGGGGGGDFGETAGGARSRYGGGGGGGRGDYSDHDNKSGYVKLFVGSVPRTANEDDVRPLFEDHGDVLEVALIRDRKTGEQQGEP

SEQ ID NO: 343 - DNA, 985 bp, Zea mays
  misc_feature (1)..(985): Ceres CLONE ID no. 325565
  misc_feature (1)..(985): Also Known As Ceres GEMINI ID no. 538G10
acctcttcaatcccaatcccacacaaagtttctcctcgatcctcatctccctctctcgagtcaagagcagagcagctaccaaacaagctctcctttcgcttccgatccatggagctcgatgccgacaacctgagcgccaccgagctccgcctcggcctgcctgggaccagcagcagcagcagagacgactggcagaagaagccgtcgccctccgtcggggccaagcgcgttctggacgacggcaccaagagcgaggcctcggggaccagcacggccgccggagacctcgacttcgaccacgacaccgccgcgcctcccaaggcgcaagtggtcgggtggccgccggtgagggcgtacaggaagaacaccttccaggcggcggcggccaaaaaggtcgagcagaagcagcagcagggaggcctgtacgtgaaggtgagcatggacggcgcgccgtacctcaggaaggtggacctccggatgtacaaggggtacagggagctcagggaggctctggacgcgctcttcaccaactccttctccgcggcggcggcagagggcggcggcgaccaccagcacgccatcgcctacgaggacaaggacggcgacctcatgctcgccggagacgtgccctgggatatgttcatctcttcttgcaagaagctgaggataatgaagggctctgcctctgaggccaggtgatcgctgatccatacataaacagaggctacagacacgccacctgggaacgcggatccaagagcacacacggatcgtacgtgacgaggaaggagggaggagctgtgtggcttgagctctccagtgttgtacaaaggcatgtttctttctgaacccaaaagggagaaagatgtatgaagcgtgtatataaaatcttagctagcagtttgttttcaaactgtgttttgtatgagcgatcgaaggctgcaaaaatatgaaaaaaaaaatgaaaagggaatgagaaattggc

SEQ ID NO: 344 - protein, 196 aa, Zea mays
  misc_feature (1)..(196): Ceres CLONE ID no. 325565
  misc_feature (1)..(196): Also Known As Ceres GEMINI ID no. 538G10
  misc_feature (7)..(191): Pfam Name: AUX_IAA Pfam Description: AUX/IAA family
MELDADNLSATELRLGLPGTSSSSRDDWQKKPSPSVGAKRVLDDGTKSEASGTSTAAGDLDFDHDTAAPPKAQVVGWPPVRAYRKNTFQAAAAKKVEQKQQQGGLYVKVSMDGAPYLRKVDLRMYKGYRELREALDALFTNSFSAAAAEGGGDHQHAIAYEDKDGDLMLAGDVPWDMFISSCKKLRIMKGSASEAR

SEQ ID NO: 345 - protein, 219 aa, Oryza sativa subsp. japonica
  misc_feature (1)..(219): Public GI No. 50934701
  misc_feature (1)..(219): Functional Homolog of  Ceres CLONE ID no. 325565 at SEQ ID NO. 344 with e-value of 2.70E-58 and percent identity of 76.5
MASSSSLRSTSCLASAAETDADNLCLRLGPPGSSITTTTTTGGADPAAKRSLGAKRSLESTDSMASGTGTSAAGDEHDDDTAAPAKAQVVGWPPVRAYRRNTFHQAAAAAAATKKGGDEKQKQQQQGGGLYVKVSMDGAPYLRKVDLKMCKGYRELREALDLLFTKCFSATASDGCSDGQFAIAYEDKDGDLMLVGDVPWEMFISSCKKLRIMKGSEAR

SEQ ID NO: 346 - protein, 204 aa, Populus tremula x Populus tremuloides
  misc_feature (1)..(204): Public GI No. 20269063
  misc_feature (1)..(204): Functional Homolog of  Ceres CLONE ID no. 325565 at SEQ ID NO. 344 with e-value of 4.80E-45 and percent identity of 57.1
MEFERDLNLDATELRLGLPGTATRQSEKQTPNSNLAKSNKRSLPDMNEDPAGSSRENSSTVSSNEEKSHDQETAPPPIKAQVVGWPPIRSYRKNCLQAKKQEAEAAGLYVKVSMDGAPYLRKIDLKVYKGYPELLKALEEMFKSKVGEYSEREGYNGSEHVPTYEDKDGDWMLVGDVPWDMFINSCKRLRIMKESEARGLGCAV

SEQ ID NO: 347 - protein, 203 aa, Vigna radiata
  misc_feature (1)..(203): Public GI No. 7442240
  misc_feature (1)..(203): Functional Homolog of  Ceres CLONE ID no. 325565 at SEQ ID NO. 344 with e-value of 6.69E-39 and percent identity of 53.3
MGSYETELNLRATELRLGLPGSDEPQEKRPCSGSVVRSSNKRSSPELEESRCKSNINSDSSDSTTTSDHNEDSVQPAKVQVVGWPPIRSFRKNSLQQKKVEQGDGTGMYLKVSMAGAPYLRKIDLKVYKSYPELLKALQNLFKCTFGEYSEREGYNGSEYAPTYEDKDGDWMLVGDVPWNMFVSSCKRLRIIKGSEAKGLGCL

SEQ ID NO: 348 - DNA, 921 bp, Zea mays
  misc_feature (1)..(921): Ceres CLONE ID no. 331626
  misc_feature (1)..(921): Also Known As Ceres CDNA ID no. 23765288
  misc_feature (1)..(921): Also Known As Ceres GEMINI ID no. 538H4
gagcaacaagagagagaggacatagccgcacaaagggaaggagaccctcgccaacctcgaagctagtccaaactagtgggaggttgagtgcagggatcgatcgaggaagacgagacaagcttcttcttctgctgccgccgccgccagctctagctcaccacgagttactagccaatctgacaccgaccgtccatggcgcggggcaaggtgcaacttcggcgcgtcgagaacccggtgcaccggcaggtgacattctgcaagcgccgcgcggggctgctcaagaaggcccgggagctctccgtcctctgcgacgccagcgtcggcatcatcgtcttctccgcgcacggcaagctctacgacctcgccaccaccgggaccatggaggagctgatcgagaggtacaaggctgccagcgccggagaagcgacgaccgacggctgcggcaggcacaacaggatggaccccaaacatgaaaccacggtgctgcaacaggaaatcaacctgcttcagaagggactgaggtacatctacgggaacagggcgaacgagcacatgaatgttgacgaactgaacgccctagagaggtacttggagatatggatgtacaacacccgctctgcaaagatgcagataatggctcaagagatccaagcactgaaaagcaaggaaggcatgttgaaagctgccaacgagattctccaggaaaagatagtagagcagagtagtttgcttgacgtaggcatggtggtagcggaccagcagaatgggcgttttagcacagtcccactggtagaagaggtgatcagtagtaacccactgactatactgagtggctattctagctgtaggggttcagagatgggctactccttctgttgattactactagtgtgtaatacatacagtcaataatgtctgtgt

SEQ ID NO: 349 - protein, 228 aa, Zea mays
  misc_feature (1)..(228): Ceres CLONE ID no. 331626
  misc_feature (1)..(228): Also Known As Ceres CDNA ID no. 23765288
  misc_feature (1)..(228): Also Known As Ceres GEMINI ID no. 538H4
  misc_feature (81)..(175): Pfam Name: K-box Pfam Description: K-box region
  misc_feature (9)..(59): Pfam Name: SRF-TF Pfam Description: SRF-type transcription factor ( DNA-binding and dimerisation domain)
MARGKVQLRRVENPVHRQVTFCKRRAGLLKKARELSVLCDASVGIIVFSAHGKLYDLATTGTMEELIERYKAASAGEATTDGCGRHNRMDPKHETTVLQQEINLLQKGLRYIYGNRANEHMNVDELNALERYLEIWMYNTRSAKMQIMAQEIQALKSKEGMLKAANEILQEKIVEQSSLLDVGMVVADQQNGRFSTVPLVEEVISSNPLTILSGYSSCRGSEMGYSFC

SEQ ID NO: 350 - protein, 201 aa, Lycopersicon esculentum
  misc_feature (1)..(201): Public GI No. 24967140
  misc_feature (1)..(201): Functional Homolog of  Ceres CLONE ID no. 331626 at SEQ ID NO. 349 with e-value of 8.50E-55 and percent identity of 60.3
MARGKVQMKRIENPVHRQVTFCKRRAGLLKKAKELSVLCDAEVGLFIFSAHGKLYELATKGSMQGLIERYIKSTKGVEVAEEAKDTQPLDPKEEINMLKNEIDVLQKGLSYMYGGGAGTMTLDELHSLEKYLEIWMYHIRSAKMDIMFQEIQLLKNKGGILEAANKYLQDKIDEQYTVTNMTQNLTDFQCPLTVQNEIFQF

SEQ ID NO: 351 - protein, 224 aa, Oryza sativa subsp. indica
  misc_feature (1)..(224): Public GI No. 21586457
  misc_feature (1)..(224): Functional Homolog of  Ceres CLONE ID no. 331626 at SEQ ID NO. 349 with e-value of 5.30E-94 and percent identity of 85.3
MARGKVQLRRIENPVHRQVTFCKRRAGLLKKARELSILCEADIGIIIFSAHGKLYDLATTGTMEELIERYKSASGEQANACGDQRMDPKQEAMVLKQEINLLQKGLRYIYGNRANEHMTVEELNALERYLEIWMYNIRSAKMQIMIQEIQALKSKEGMLKAANEILQEKIVEQNGLIDVGMMVADQQNGHFSTVPLLEEITNPLTILSGYSTCRGSENGLFLLT

SEQ ID NO: 352 - protein, 222 aa, Oryza sativa subsp. japonica
  misc_feature (1)..(222): Public GI No. 50940449
  misc_feature (1)..(222): Functional Homolog of  Ceres CLONE ID no. 331626 at SEQ ID NO. 349 with e-value of 1.50E-96 and percent identity of 86.0
MARGKVQLRRIENPVHRQVTFCKRRAGLLKKARELSILCEADIGIIIFSAHGKLYDLATTGTMEELIERYKSASGEQANACGDQRMDPKQEAMVLKQEINLLQKGLRYIYGNRANEHMTVEELNALERYLEIWMYNIRSAKMQIMIQEIQALKSKEGMLKAANEILQEKIVEQNGLIDVGMMVADQQNGHFSTVPLLEEITNPLTILSGYSTCRGSEMGYSF

SEQ ID NO: 353 - protein, 204 aa, Magnolia praecocissima
  misc_feature (1)..(204): Public GI No. 16549066
  misc_feature (1)..(204): Functional Homolog of  Ceres CLONE ID no. 331626 at SEQ ID NO. 349 with e-value of 3.10E-50 and percent identity of 60.0
  misc_feature (34)..(34): Xaa is any aa, unknown, or other
  misc_feature (35)..(35): Xaa is any aa, unknown, or other
  misc_feature (85)..(85): Xaa is any aa, unknown, or other
  misc_feature (86)..(86): Xaa is any aa, unknown, or other
MARGKIQMKRIENSVHRQVTFCKRRAGLLKKARXXSVLCDVDIGLMIFSTHGKLYELATKGTMEGLIERYLGTSRGAQIEGGPAXXPPESDQEVFMLKQEIELLQKGLRNSIGGGMGNMTMDELHALERHLELWIYHIRSTKMRIMIQEIQSLKDNEGILKSANEFLQGKIEEQNVIFDMPPMIGGIPYPLTIPNEIFLEELNY

SEQ ID NO: 354 - DNA, 1363 bp, Zea mays
  misc_feature (1)..(1363): Ceres CLONE ID no. 333416
  misc_feature (1)..(1363): Also Known As Ceres CDNA ID no. 23767681
  misc_feature (1)..(1363): Also Known As Ceres GEMINI ID no. 538H6
atcagtccaatcatatcccagcacgaagagccgccgcaatcctcctccccgtcccctaccttcgtcggtgctctcacccgccgctggtcgccattcctccagatcggcgcccagctcgcagcccactaggcgttgcgctccctctccaaacccaacgaaaccccaggggaaccctcatccccctgtcgtctcccttattgggggccagacatggagagcaagcaatgggggaagacgccccaggaggtggtgggcgcaggcggcggtcgccaagtggatctagatgaagaggatgacctggaggagttccggctgcccatgggccaccgccccaccgagaacctcgacacggaggggctccagcaggcctctgtctacacccagctcaccgcgtccaacgtcggtttcaggctactgcagaagatgggctggaagaccggcaaggggctcggcaagaacgagcaaggtatactagagccaataagagctgacatgagagatgcaaaattaggtgttgggaagcaagaggaagatgacttcttcacatctgaagagaatgtgcaacgaaagaaattgaatattgaacttgaggagactgaggaacatataaagaaacgggaggtcatagcagagcgtgagcacaaaatccgcagtgaagtcaaggagatacagaaggtgtttttttgcaacctctgcaataagcagtacaagctggctcatgaatttgagagtcacttgagctcatatgaccacaatcataggaagaggtttaaggaaatgagagaaatgcagagcagcagtggtagtcgagatgacagacagaaacgtgaacaacaacgagaagagaaggagctggcaaaaattgctcaacttgcggatgctcataggaagcagcagaaggataagcaagaaaagtcagagacggaggatgcggcacccaaaaacatggcagcctctagcaaccaggatcagaggcaaaccttgaagttcggattctctaaaatggctccttccaaggttctagttggtagtgccagcaagaagccaaaggttgccacgaaagtttcttctgtctttggcaacgagagtgatgaggactcgtgacctttgccagagggtggcagttgcttcttctgtcgtggcatttggtctggggacttgataacagcatcgagaattgtatgaacttttgagggtacactgtataaggaaatctgtactgttgttgctggattttggaagctgtttattaaccattcgcccttgtaggcaggcaatacccttcagtttgggacacacctttgtattgtaggctgtactatcgttgttggcttttaatgttaaaaaaaaacctttgtattcg

SEQ ID NO: 355 - protein, 297 aa, Zea mays; identical to SEQ ID NO: 117
  misc_feature (1)..(297): Ceres CLONE ID no. 333416
  misc_feature (1)..(297): Also Known As Ceres CDNA ID no. 23767681
  misc_feature (1)..(297): Also Known As Ceres GEMINI ID no. 538H6
  misc_feature (61)..(105): Pfam Name: G-patch Pfam Description: G-patch domain

SEQ ID NO: 356 - protein, 301 aa, Arabidopsis thaliana; identical to SEQ ID NO: 115
  misc_feature (1)..(301): Ceres CLONE ID no. 108509
  misc_feature (1)..(301): Also Known As Ceres CDNA ID no. 23365210
  misc_feature (1)..(301): Also Known As Ceres GEMINI ID no. 539G6
  misc_feature (1)..(301): Functional Homolog of  Ceres CLONE ID no. 333416 at SEQ ID NO. 355 with e-value of 1.19E-82 and percent identity of 63.3

SEQ ID NO: 357 - protein, 306 aa, Triticum aestivum; identical to SEQ ID NO: 116
  misc_feature (1)..(306): Ceres CLONE ID no. 764678
  misc_feature (1)..(306): Functional Homolog of  Ceres CLONE ID no. 333416 at SEQ ID NO. 355 with e-value of 5.49E-115 and percent identity of 81.5

SEQ ID NO: 358 - DNA, 780 bp, Zea mays
  misc_feature (1)..(780): Ceres CLONE ID no. 333753
  misc_feature (1)..(780): Also Known As Ceres CDNA ID no. 24385563
  misc_feature (1)..(780): Also Known As Ceres GEMINI ID no. 538C6
tccactcgcacgctaaccctacacactcccgtttacgggcacacctccaaaccctcatcacgatccggctccaaggtctcgagatgaagtcgagggcgaggtccggcggtggcgactccaggctctcggtgaggaagaccaaggttgagaaggacccaaacaagcccaagaggcctccgaccacgttcttcgtcttcatggaggagttcaggaaggactacaaggagaagcaccccaatgtgaagcaagtctcagtcattggcaaggctggtggtgacatgtggaagtccttgtctgatgccgagaaggctccctacgtatctaaggccgagaagctgaaggttgagtacacaaagaagatggacgcctataacaacaagcagtctggaggaggacccacattgtctggtgattctgacaagtccaagtccgaggtcaacgacggggacgaggagggtgatgagtgatggatgacgggtgaaactctgggctgcccaagtgcttgcagtcagcagggaaatctcatcgtcgttgggcctaaccgggctttgctgctccgtagcgtctggaagctgtctgtcttttgagatgctgtagactagtagtgcctgctctgagttagtaattgaaagtgttgtccctgaagtgatgctgtttagttggtagtgtgttcgcttcttcggcacttatacttacccccaagcatcaacgctgcctgttttaaatctcaataggtgctgttttaaatctcagatctcaatatatgactactgatcgctg

SEQ ID NO: 359 - protein, 127 aa, Zea mays
  misc_feature (1)..(127): Ceres CLONE ID no. 333753
  misc_feature (1)..(127): Also Known As Ceres CDNA ID no. 24385563
  misc_feature (1)..(127): Also Known As Ceres GEMINI ID no. 538C6
  misc_feature (28)..(97): Pfam Name: HMG_box Pfam Description: HMG (high mobility group) box
MKSRARSGGGDSRLSVRKTKVEKDPNKPKRPPTTFFVFMEEFRKDYKEKHPNVKQVSVIGKAGGDMWKSLSDAEKAPYVSKAEKLKVEYTKKMDAYNNKQSGGGPTLSGDSDKSKSEVNDGDEEGDE

SEQ ID NO: 360 - protein, 126 aa, Zea mays
  misc_feature (1)..(126): Public GI No. 17017392
  misc_feature (1)..(126): Functional Homolog of  Ceres CLONE ID no. 333753 at SEQ ID NO. 359 with e-value of 4.59E-56 and percent identity of 90.4
MKSRARSTAGDSRLSVRKTKAEKDPNKPKRPPSAFFVFMEEFRKDYKEKHPNVKQVSLIGKAGGDKWKSLSDAEKAPYVSKAEKLKAEYTKKIDAYNNKQSGDPTASGDSDKSKSEVNDEDEEGDE

SEQ ID NO: 361 - protein, 127 aa, Oryza sativa subsp. japonica
  misc_feature (1)..(127): Public GI No. 50726318
  misc_feature (1)..(127): Functional Homolog of  Ceres CLONE ID no. 333753 at SEQ ID NO. 359 with e-value of 1.80E-52 and percent identity of 83.3
MKARSRSSNGDSRLSVRKTKAEKDPNKPKRPPSAFFVFMEQFRKDYKEKHPNVKQVSVIGKAGGDKWKSMTDADKAPFVTKAEKLKAEYTKKIDAYNNKQAGGPATSGDSDKSKSEVNDEDEGSGDE

SEQ ID NO: 362 - DNA, 1893 bp, Zea mays
  misc_feature (1)..(1893): Ceres CLONE ID no. 335011
  misc_feature (1)..(1893): Also Known As Ceres CDNA ID no. 23768333
  misc_feature (1)..(1893): Also Known As Ceres GEMINI ID no. 538F7
actataataggttctctcgagccttcgccgccgagagcccgatacccgccgtcctccctgctcctgctgccgcgtgcccctctccggccacccgccgccggcgcagtgtccatgaactagcacctctttcttcgcccggtacccattcagttcgtccgcctccttctcttcgagtttgggtgcccatggagaccagcagtgcgcccgccgccgccaccgaggccggctggtacgtgcttggaccgaaccaggagggcgtcggaccctacgcgcttgctgagcttcgagaacatttcgcaaacggttatttcaatgagagcacaatgctctgggcagaagggaggaaggaatggatgccactctcgtccatctctgagctacactccgcagtcgcagcgaaggatcaatctgaacaagatgctccagatgttgatgatgattttgagaaatttcagaaggaggttatcgaagccgagacagaggtgaaggccttgaaaggcaatgatgtggaccagcaagatgatgagcggccagcaaccccccctgatggagaggaagaatttactgatgatgatggcaccatttacaaatgggaccgtactttgagggcatgggttcctcaaaatgatgcatctggtagcaaggaagattacgctgttgaagagatgacttttgcagttgaggaggaaatatttcaggcacccgatatcctgggtcctgcattagaagaaatcaacaatctacctgaaagcaaaaataaaggatcagataaagcagaaatgagaggagacaaaaagcggaaatcttatgagaatccagctgagaaaaaggaagctaacaaacctccggacagttggtttgatctcaaagtaaacacacatgtctatgtaactggtttgcctgatgatgtcacagtggaggagattgtggaggtattttccaagtgcggaataataaaggaggacccagagactaaaaagccacgagtgaagatttatactgatagagaaaccggcaggaagaagggtgatgccttggtgacatatttcaaggagccttctgtagctttagcggttcaattgttggatgggacaccattccgtcctggtggtaagactcatatgtctgtaagtccagccaaatttgagcagaaaggtgatgttttcgtttcaaagaaaactgacaagcaaaagaagaggaagataaagaaggttgaggacaaaatgcttggatggggtgggcatgacgataagaagctgatgattcctgctacagtaattttaaggcacatgttcactcctgctgagctgagagctgatgaagagcttcttcctgagcttgaggctgatgttagagaggaatgcatcaagtttggtccggtggataatgtcaaggtttgtgaaaatcatccacaaggtgtcatattggtgagattcaaagacaggaaagatggtgccaaatgcatagagaagatgaacggcagatggtttgctggacggcaaatccatgcgagcgaagacgatggctctgttaaccatgctcttatccgtgattacgacgcggaggtgtcaaggctggatcgatttggacaagagctagaagagtccacatagagtgtatatatacacacacacctgggattagagtaggtgtgttacctcattcataggtaggttcgcctgattgaacatgagaaagaagttattggatacacctgctaataagagtagtgaccggcttgcagagctggtgatatcatcactagcgaagtagcagcacactgctttctcaaatgtgttgtttaatgaatgagaagctcatatcgatactattaacctcggctccctatgaaagtacagtgggcatttctatctgaaatgtgggaatttttat

SEQ ID NO: 363 - protein, 475 aa, Zea mays
  misc_feature (1)..(475): Ceres CLONE ID no. 335011
  misc_feature (1)..(475): Also Known As Ceres CDNA ID no. 23768333
  misc_feature (1)..(475): Also Known As Ceres GEMINI ID no. 538F7
  misc_feature (386)..(442): Pfam Name: RRM_1 Pfam Description: RNA recognition motif. ( a.k.a. RRM, RBD, or RNP domain)
METSSAPAAATEAGWYVLGPNQEGVGPYALAELREHFANGYFNESTMLWAEGRKEWMPLSSISELHSAVAAKDQSEQDAPDVDDDFEKFQKEVIEAETEVKALKGNDVDQQDDERPATPPDGEEEFTDDDGTIYKWDRTLRAWVPQNDASGSKEDYAVEEMTFAVEEEIFQAPDILGPALEEINNLPESKNKGSDKAEMRGDKKRKSYENPAEKKEANKPPDSWFDLKVNTHVYVTGLPDDVTVEEIVEVFSKCGIIKEDPETKKPRVKIYTDRETGRKKGDALVTYFKEPSVALAVQLLDGTPFRPGGKTHMSVSPAKFEQKGDVFVSKKTDKQKKRKIKKVEDKMLGWGGHDDKKLMIPATVILRHMFTPAELRADEELLPELEADVREECIKFGPVDNVKVCENHPQGVILVRFKDRKDGAKCIEKMNGRWFAGRQIHASEDDGSVNHALIRDYDAEVSRLDRFGQELEEST

SEQ ID NO: 364 - protein, 503 aa, Glycine max
  misc_feature (1)..(503): Ceres CLONE ID no. 553817
  misc_feature (1)..(503): Functional Homolog of  Ceres CLONE ID no. 335011 at SEQ ID NO. 363 with e-value of 0.0 and percent identity of 67.6
MTSLNGDESHHPPPQPQAEKITEVGWYVLGEDQQQIGPYAFSELREHFLNGYLSENTFVWSEGRSEWQPLSSVSDLWAQINQQGPDSSTTVSAPDVDEFERWQKEIQEAEAQVEGSEFGSLSGNAGSTGAGEDSERPSTPPEGEEEFTDDDGTVYKWDRNLRAWVPQEHPTGSTEPYGVQEMTFLEEEEVFPTIPISDASEKFEDSPKLSVSVPPLKEETNEANNTNVVSGEKRKLSDQQTDKKEANKPPDSWFELKINTHVYVTGLPEDVTTDEIVEVFSKCGIIKEDPETKKPRVKLYVDKGTGRKKGDALVTYLKEPSVALAIQILDGAPLRPNGKIPMSVSQAKFEQKGDKFVSKQVDNKKKKKLKKVEDKMLGWGGRDDAKVSIPATVILRYMFAPAEMRADENLRLELEEDVKEECTKLGPLDSVKICENHPQGVVLVRFKDRKDAQKCIELMNGRWFGGRQIHASEDDGSVNHALVRDLEEDAIRLEQFGAELEGD

SEQ ID NO: 365 - protein, 487 aa, Triticum aestivum
  misc_feature (1)..(487): Ceres CLONE ID no. 780844
  misc_feature (1)..(487): Functional Homolog of  Ceres CLONE ID no. 335011 at SEQ ID NO. 363 with e-value of 0.0 and percent identity of 78.6
MEGGGEVGWYVLGPSQEHVGPYALSELRDHFANGYLNESTMLWAEGRSEWTPLSSIPELHSGVTKKYQPEQETEDDFEKFQKEVIEAESEVEALKAKAADGDLSKEHVIDDPDERPASPPDGVEEFTDDDGTIYKWDRTLRAMVPQNDVSGEMDNNGENDISRKKDDYELEDMTFALEEEVFQPPDIPGSSTLDENHALTEKENKVPEKVDKRLEKKRKSEKPTEKKEPQKPPESWFDLKVNTHVYVTGLPEDVTAEEIVEVFSKCGIIKEDPETRKPRVKIYTDKETGRKKGDALVTYLKEPSVPLAIQLLDGTSFRPGGKTLMTVSVAKFQQKGDVFLAKKADKQKKKKGKKVEDKMLGWGGHDDKKVMIPTQVILANMFSPAELRNDETLLPELEVDVREECVKFGPIDNVKVCENHPQGVVLVKFKDRKDGLKCIEKMNGRWFGGKQIHASEDDGSIKHALIRDYDAEVSRLERFGEELEEST

SEQ ID NO: 366 - protein, 476 aa, Oryza sativa subsp. japonica
  misc_feature (1)..(476): Public GI No. 50925969
  misc_feature (1)..(476): Functional Homolog of  Ceres CLONE ID no. 335011 at SEQ ID NO. 363 with e-value of 0.0 and percent identity of 80.9
MEGGGEVGWYVLGPNQEHVGPYALSELREHFANGYISESSMLWAEGRSEWMPLSSIPDLLAVVTKKDQPDEGIEDDFDKFQKEVIEAEAEVEASTDKAADNDINQEHGADDPDDRPATPPDGEDEFTDDDGTVYKWDRVLRAWVPQDDLEGKNDNYEVEDMTFAHEEEVFQAPDIAGSTTLEENNVSAEIEIKEPTKVEKRADKKRKSSEKPADKKEANKPPDSWFDLKVNTHVYVTGLPDDVTAEEIVEVFSKCGIIKEDPETRKPRVKIYTDRETGRKKGDALVTYLKEPSVALAIQLLDGTSFRPGGKTLMSVSPAKFEQKGDVFISKKTDKQKKRKTKKVEDKILGWGGHDDKKVTITTTVILRHMFTPAELRADETLLPELEADVREECMKLGPVDNVKVCENHPEGVILVKFKDRKDGIKCIEKMNGRWFGGNQIQASEDDGSINHALIRDYDAEVSRLDRFGEELEEST

SEQ ID NO: 367 - DNA, 1417 bp, Zea mays
  misc_feature (1)..(1417): Ceres CLONE ID no. 335471
  misc_feature (1)..(1417): Also Known As Ceres CDNA ID no. 23778718
  misc_feature (1)..(1417): Also Known As Ceres GEMINI ID no. 538D8
actatcctggccgccatgcccactcctggtatcctatgatatcaaccgcatcctctattccagttcttctccacctcacctcgtcctcgtgccttctcgcccgcccccccaaaattcacccgtccaccctctaccaccacgtcggcgcgggtagcagttggtctcatcgtcctcgcacctgacgacgtcgcggttcgcgctctcgcctcctgccgcgtgcccattcctcgccctcgtctcctgcgagttcccacgccccccggtgccgccacccggagccagtcctcgccgcattgttcttgttcccctcctcctggtgatcccgcaccgcgctgtgtcctctccatcttcctccgccgccacgctcatcgccggttcatgtttcatcttaaggaatgaccagcagtcgacaaatggaactgcactacataaacactggatttccatacacaatcaccgagagtttcatggatttctttgagggtctcacttatgctcatgctgactttgctctcatggatggctttcaggatcagggtaatccgtactggacaatgatgcatacaaactcatacaagtatggatactctggttctgggaactattacagttatgctcatgcctatgacattgacgattacatgcatagaactgatggtgggcgcagaacatgggataacactacacctgtaaacaatgtggattctgccaatgttgtcctgcagggtggtgaagctccccgcacaactgcaaatactactagtgaggattgcatccaacaggtacaccaaagtccgggtagtcctcaggttgtttggcaagacaacattgaccctgacaatatgacatatgaggaactcttggatttgggtgaggcagttggaacccagagccgtggtctctctcaagaatgcatttcattgcttcccatcactaagtataagtgtggattcttttcaaggaagaaaacacgccgtgaaaggtgtgtgatttgccaaatggagtacaggagaggaaatttgcagattacgcttccatgcaagcatgtataccatgccagctgcgtgacaagatggcttagcataaacaaggtatgccctgtttgctttgctgaagttcctggcgaggattctctgaggcaatgattcatcagttgtgatgccactatgaagttgctgctctgggtactgcgcccccaatggacgcatgatttctgctttgaaggcagcttgttgtccccactttagaattgtgtattagcgccatattaccaaataggttattacttatcagatgtatttaggtagtgtttggtttcagaatatggtaggatggagtcactttgctcctaatttattgttgtttgaattgatttcatgtaggacatagtaactctaaaaatggaaaaactatgctt

SEQ ID NO: 368 - protein, 249 aa, Zea mays
  misc_feature (1)..(249): Ceres CLONE ID no. 335471
  misc_feature (1)..(249): Also Known As Ceres CDNA ID no. 23778718
  misc_feature (1)..(249): Also Known As Ceres GEMINI ID no. 538D8
  misc_feature (197)..(237): Pfam Name: zf-C3HC4 Pfam Description: Zinc finger, C3HC4 type (RING finger)
MTSSRQMELHYINTGFPYTITESFMDFFEGLTYAHADFALMDGFQDQGNPYWTMMHTNSYKYGYSGSGNYYSYAHAYDIDDYMHRTDGGRRTWDNTTPVNNVDSANVVLQGGEAPRTTANTTSEDCIQQVHQSPGSPQVVWQDNIDPDNMTYEELLDLGEAVGTQSRGLSQECISLLPITKYKCGFFSRKKTRRERCVICQMEYRRGNLQITLPCKHVYHASCVTRWLSINKVCPVCFAEVPGEDSLRQ

SEQ ID NO: 369 - protein, 253 aa, Zea mays
  misc_feature (1)..(253): Ceres CLONE ID no. 226047
  misc_feature (1)..(253): Functional Homolog of  Ceres CLONE ID no. 335471 at SEQ ID NO. 368 with e-value of 1.79E-125 and percent identity of 91.4
MNSSRQMELHYINTGFPYTITESFMDFFEGLTYAHADFALTDGFQDQGNPYWAMMHTNSYKYGYSGPGNYYSYADVYDIDDYMHRANGERRIWDNTTPVNNVDSANVVLQGGEAPRTTANTINKECIQQVHQSPGSPQVVWQDNIEPDNMTYEELLDLGEAVGTQSRGLSQERISSLPVTKYKCGFFSRKKTCRERCVICQMEYRRGNLQMTLPCKHVYHASCVTRWLGINKVCPVCFAEVPGEDPEAMSQQL

SEQ ID NO: 370 - protein, 248 aa, Arabidopsis thaliana
  misc_feature (1)..(248): Public GI No. 33589800
  misc_feature (1)..(248): Functional Homolog of  Ceres CLONE ID no. 335471 at SEQ ID NO. 368 with e-value of 2.90E-61 and percent identity of 52.9
MNGDNRPVEDAHYTETGFPYAATGSYMDFYGGAAQGPLNYDHAATMHPQDNLYWTMNTNAYKFGFSGSDNASFYGSYDMNDHLSRMSIGRTNWDYHPMVNVADDPENTVARSVQIGDTDEHSEAEECIANEHDPDSPQVSWQDDIDPDTMTYEELVELGEAVGTESRGLSQELIETLPTKKYKFGSIFSRKRAGERCVICQLKYKIGERQMNLPCKHVYHSECISKWLSINKVCPVCNSEVFGEPSIH

SEQ ID NO: 371 - protein, 248 aa, Glycine max
  misc_feature (1)..(248): Ceres CLONE ID no. 1044196
  misc_feature (1)..(248): Functional Homolog of  Ceres CLONE ID no. 335471 at SEQ ID NO. 368 with e-value of 4.00E-64 and percent identity of 52.6
MSWNPHMELHYNTISYPYNTAGSFIEYFEGLTYEHVNFIFSGASHAQESSYPSNSSFYKFGISEPVNTSYYRYGHGYEVNHHEPLVDEYRRPSENSLTINEQSAAVSTEWVEGGNTGTRDNSIECPRRHHSNSNDYQVIWQDNIDPDNMTYEELLELGEAVGTQSRGLTQEQISSLPVSKYKCGFFSRKKSRDERCVICQMEYKRGDKRITLPCKHVYHASCGNKWLSINKACPICYTEVFADKSKHK

SEQ ID NO: 372 - protein, 248 aa, Glycine max
  misc_feature (1)..(248): Ceres CLONE ID no. 471303
  misc_feature (1)..(248): Functional Homolog of  Ceres CLONE ID no. 335471 at SEQ ID NO. 368 with e-value of 2.79E-63 and percent identity of 51.8
MSWNPHMEVHYNTISYPYNTAGSFIEYFEGLTYEHVNFIFSGASHAQESSYPSNSSFYKFGLSEPENNSYYRYSHGYEVNHHEPLVDEYRRPSENSLTINEQSPAVSTEWVEGGNTDTQDNSIECPRRHHSNSNDYQVIWQDNIDPDNMTYEELLELGEAVGTQSRGLTQEQISSLPVSKYKCGFFLRKKSRDERCVICQMEYRRGDKRITLPCKHVYHASCGNKWLSINKACPICYTEVFADKSKHK

SEQ ID NO: 373 - DNA, 1588 bp, Zea mays
  misc_feature (1)..(1588): Ceres CLONE ID no. 336323
  misc_feature (1)..(1588): Also Known As Ceres CDNA ID no. 23764214
  misc_feature (1)..(1588): Also Known As Ceres GEMINI ID no. 538D9
cccggcttaggaaccctcgaaaagacgcctcaccatctcctttgtgtccttgctaactaactccccattagatccggccttcttcctccccgtctccgtcctttgtgtccagttgcttcataagctacccatcgccaattcgccatatacgcacatacccaacgacgacgcacgcgcgtgcgcaaaccaccaaccggagcgagtaccaaccggccggcccgcccaacaagcaggcggctagccatcgacgaccgagcacatcgagctgcccccggccggtcatatatatatgcagggcggcggcggtgatcaagcaggagggagcctgggcatgggcatgggcgtggggtacgccggcggcggaggcgccgagtgctcgtcgtcctcggtggcggccgcggctgccgccgccgcggcggcggcggaggcggaggagcggcagctgctcaagggggagatcgcggtgcacccgctgtgcgagcagctggtggcggcgcacgtggggtgcctgcgcgtggccacgcccatcgaccacctccccctcatcgacgcccagctcgcgcagtccagcggcctcctccactcctacgccgcccaccacagccccttcctctccccgcacgacaagcacgacctcgactccttcctcgcgcagtacctgatgctgctgtgctcgttccgggagcagctgcagcagcacgtccgggtgcacgccgtggaggccgtcatggcatgccgcgagatcgagcagtccctgcaagacctaactggggtgacgctggaggaagggacgggagcgaccatgtcggaggaggacgaggacgaggcgccgatgctggaggtgggtctggtggacatgggctccgacgggcacgacatgatgggcttcggcccgctcctgcccaccgactccgagcgctcgctcatggatagggtccgacaggagcttaagatcgagctcaagcagggtttcaagtcaagaatagaggatgtgagggaggagattctgaggaaaaggagggccgggaagctgcctggggacaccaccagcatcctcaagcaatggtggcagcagcactccaagtggccataccccacggaggacgataaggcgaggctcgttgaagagaccggcctgcagctgaaacaaatcaacaactggttcatcaaccagaggaagaggaactggcacaacaactcccagacgtcaaccctcaaatcaaagcgtaaaaggtgatggagagctgcgccaccatgtactgcacacctgacacgtataccaattaccaacacgctaatcagacgacgtacggccatgcatggcgactcacaagaaataaagaggatcgatcgattcaactgtatatttctagtcattagtcagagaggtgacaggttcatgacacacacaaacacacgtacactagtctgaccactggcatatttgcttgctgtgattaatattttgagccgatcatttgctcggagcatactttattcttgttattattgtacagccatagtttgtcctcccagcgtacgtacataatctttgaggttgcattcatatatacagtgatctgatctg

SEQ ID NO: 374 - protein, 315 aa, Zea mays
  misc_feature (1)..(315): Ceres CLONE ID no. 336323
  misc_feature (1)..(315): Also Known As Ceres CDNA ID no. 23764214
  misc_feature (1)..(315): Also Known As Ceres GEMINI ID no. 538D9
  misc_feature (106)..(161): Pfam Name: KNOX2 Pfam Description: KNOX2 domain
  misc_feature (219)..(240): Pfam Name: ELK Pfam Description: ELK domain
  misc_feature (51)..(95): Pfam Name: KNOX1 Pfam Description: KNOX1 domain
MQGGGGDQAGGSLGMGMGVGYAGGGGAECSSSSVAAAAAAAAAAAEAEERQLLKGEIAVHPLCEQLVAAHVGCLRVATPIDHLPLIDAQLAQSSGLLHSYAAHHSPFLSPHDKHDLDSFLAQYLMLLCSFREQLQQHVRVHAVEAVMACREIEQSLQDLTGVTLEEGTGATMSEEDEDEAPMLEVGLVDMGSDGHDMMGFGPLLPTDSERSLMDRVRQELKIELKQGFKSRIEDVREEILRKRRAGKLPGDTTSILKQWWQQHSKWPYPTEDDKARLVEETGLQLKQINNWFINQRKRNWHNNSQTSTLKSKRKR

SEQ ID NO: 375 - protein, 291 aa, Arabidopsis thaliana
  misc_feature (1)..(291): Ceres CLONE ID no. 106887
  misc_feature (1)..(291): Functional Homolog of  Ceres CLONE ID no. 336323 at SEQ ID NO. 374 with e-value of 1.19E-105 and percent identity of 74.8
MQEAALGMMGASVGGDGDAAVVAEQNRQLKGEIATHPMYEQLLAAHVACLRVATPIDQLPIIEAQLSQSHHLLRSYASTAVGYHHDRHELDNFLAQYVMVLCSFKEQLQQHVRVHAVEAVMACREIENNLHSLTGATLGEGSGATMSEDEDDLPMDFSSDNSGVDFSGGHDMTGFGPLLPTESEKSLMERVRQELKLELKQGFKSRIEDVREEIMRKRRAGKLPGDTTTVLKNWWQQHCKWPYPTEDDKAKLVEETGLQLKQINNWFINQRKRNWHNNSHSLTSLKSKRKH

SEQ ID NO: 376 - protein, 283 aa, Arabidopsis thaliana
  misc_feature (1)..(283): Public GI No. 21618231
  misc_feature (1)..(283): Functional Homolog of  Ceres CLONE ID no. 336323 at SEQ ID NO. 374 with e-value of 1.49E-105 and percent identity of 75.0
MGASVGGDGDAAVVAEQNRQLKGEIATHPMYEQLLAAHVACLRVATPIDQLPIIEAQLSQSHHLLRSYASTAVGYHHDRHELDNFLAQYVMVLCSFKEQLQQHVRVHAVEAVMACREIENNLHSLTGATLGEGSGATMSEDEDDLPMDFSSDNSGVDFSGGHDMTGFGPLLPTESEKSLMERVRQELKLELKQGFKSRIEDVREEIMRKRRAGKLPGDTTTVLKNWWQQHCKWPYPTEDDKAKLVEETGLQLKQINNWFINQRKRNWHNNSHSLTSLKSKRKH

SEQ ID NO: 377 - protein, 283 aa, Arabidopsis thaliana
  misc_feature (1)..(283): Public GI No. 8493589
  misc_feature (1)..(283): Functional Homolog of  Ceres CLONE ID no. 336323 at SEQ ID NO. 374 with e-value of 2.39E-105 and percent identity of 77.1
MGATVGGDGDTAVVAEQNRQLKGEIATHPMYEQLLAAHVACLRVATPIDQLPIIEAQLSQSHHLLRSYASTAVGYHHDRHELDNFLAQYVMVLCSFKEQLQQHVRVHAVEAVMACREIENNLHSLTGATLGEGSGATMSEDEDDLPMDFSSDNSGVDFSGGHDMTGFGPLLPTESERSLMERVRQELKLELKQGFKSRIEDVREEIMRKRRAGKLPGDTTTVLKNWWQQHCKWPYPTEDDKAKLVEETGLQLKQINNWFINQRKRNWHNNSHSLTSLKSKRKH

SEQ ID NO: 378 - protein, 294 aa, Brassica napus
  misc_feature (1)..(294): Ceres CLONE ID no. 1076901
  misc_feature (1)..(294): Functional Homolog of  Ceres CLONE ID no. 336323 at SEQ ID NO. 374 with e-value of 4.50E-104 and percent identity of 75.6
MQEAALGMIGATVGGGGDGDAAVVAEQNRQMKGEIATHPMYDQLLAAHVACLRVATPIDQLPIIEAQLSHSHHLLRSYASTAVGFSHHDRQELDNFLAQYVMVLCSFKEQLQQHVRVHAVEAVMACREIENNLHSLTGATLGEGSGATMSEDEDDLQMDFSSDNSGVDFSGGHDMTGFGPLLPTESERSLMERVRQELKLELKQGFKSRIEDVREEIMRKRRAGKLPGDTTTVLKNWWQQHCKWPYPTEDDKAKLVEETGLQLKQINNWFINQRKRNWHNNSHSLTSLKSKRKH

SEQ ID NO: 379 - protein, 294 aa, Brassica napus; identical to SEQ ID NO: 378
  misc_feature (1)..(294): Public GI No. 453949
  misc_feature (1)..(294): Functional Homolog of  Ceres CLONE ID no. 336323 at SEQ ID NO. 374 with e-value of 5.80E-104 and percent identity of 75.8

SEQ ID NO: 380 - protein, 292 aa, Glycine max
  misc_feature (1)..(292): Ceres CLONE ID no. 528991
  misc_feature (1)..(292): Functional Homolog of  Ceres CLONE ID no. 336323 at SEQ ID NO. 374 with e-value of 1.09E-111 and percent identity of 79.5
MQEAGLGMGMGMMSGEVSAAGDHHRQVKAEIANHPLYEQLLSAHVSCLRVATPIDQLPLIDGQLSQSHHLLRSYASHHSHSLSPHDRQELDNFMAQYLIVLCTFKEQLQQHVRVHAVEAVMACRDIESTLQALTGVSLGEGTGATMSDDEDDLQMDGSLDQSSADGHDMMGFGPLLPTESERSLMERVRQELKIELKQGFKSRIEDVREEILRKRRAGKLPGDTTSVLKAWWQQHAKWPYPTEDDKAKLVEETGLQLKQINNWFINQRKRNWHSNSQSVNSLKSKRKREYAH

SEQ ID NO: 381 - protein, 310 aa, Zea mays
  misc_feature (1)..(310): Ceres CLONE ID no. 298091
  misc_feature (1)..(310): Functional Homolog of  Ceres CLONE ID no. 336323 at SEQ ID NO. 374 with e-value of 0.0 and percent identity of 96.4
MQRGGDQAGASLGMEMGVGYAGGGGGGECSSSSAAAAAAAAAEGEERQLLKGEIAVHPLCEQLVAAHVGCLRVATPIDHLPLIDAQLAQSSGLLHSYAAHHRPFLSPHDKHDLDSFLAQYLMLLCSFREQLQQHVRVHAVEAVMACREIEQSLQDLTGATLEEGTGATMSEDEDEAPMLEVGLDMGSDGHDMMGFGPLMPTDSERSLMERVRQELKMELKQGFKSRIEDVREEILRKRRAGKLPGDTTSILKQWWQEHSKWPYPTEDDKAKLVEETGLQLKQINNWFINQRKRNWHNNSQTSTLKSKRKR

SEQ ID NO: 382 - protein, 314 aa, Oryza sativa subsp. japonica
  misc_feature (1)..(314): Public GI No. 14149141
  misc_feature (1)..(314): Functional Homolog of  Ceres CLONE ID no. 336323 at SEQ ID NO. 374 with e-value of 0.0 and percent identity of 90.9
MQGGDHGGMEMGVGSFTGGGGGGECSSSSATAAAAAAAAAAAAAAEAEERQLLKGEIAVHPLCEQLVAAHVGCLRVATPIDHLPLIDAQLAQSSGLLHSYAAHHRPFLSPHDKQELDSFLAQYMMLLCSFREQLQQHVRVHAVEAVMACREIEQSLQDLTGATLEEGTGATMSEDEDETAPMLEGPMDMGSDGHDLMGFGPLMPTDSERSLMERVRQELKIELKQGFKSRIEDVREEILRKRRAGKLPGDTTTILKQWWQQHSKWPYPTEDDKAKLVEETGLQLKQINNWFINQRKRNWHNNSQTSTLKSKRKR

SEQ ID NO: 383 - DNA, 1166 bp, Zea mays
  misc_feature (1)..(1166): Ceres CLONE ID no. 336524
  misc_feature (1)..(1166): Also Known As Ceres GEMINI ID no. 538C9
ctaatcgaaaagagtcttgacacgagctcccacacgtacactgcataaataggcgagcagcgggagagagacgaccgacgaggacgaagaggaattaagccagagcgatcgaggtggtgtagtgtagcttccgagcgaagctcctaccgttgccgccggccggagatatgtcgtcgggcggccgacgtggcaggatcagcgacgacgagatcaacgagctgatctccaagctccaggctctcctcccggaatcctcacgccgccggaacgcgagccggtcgtcggcgtcgaagcttctgaaggagacgtgcgcctacgtcaagagcctgcaccgggaggtggacgacctctcggagcggctgtcggggctcatggagaccatggacaacgacagcccccaggccgagatcatccggagcctcctccggtgactccagagtccaggttccagccatgccgcttgccgccccggtcgtccggcgcgcgcggccgccctcttctgctgcctgccatctagctagctgccgcagccagcgcaggtgcacttgagattggagaaggagaagacgacgacgtacggccgagcttgcttgttcgctcgtttatttgttacggcgacgaccttaattgtattcctttgttcttaatttgttctcctccttctcctcctcctcctccttcgggtgcgtgtttgtttccgtgttgaattagttcaagagcaagagcccttgctcagaagaaggcgaccaaaagtgctctactcgatcttctcgtgtaccacgccagggggggttagtagagtagagataatgtatggacttctattaaccaactaaaggtaccacgtactggtaggttgtagttgcagtagactactggtagtagggtgtagttttgcagtagactactgtagcagttctacattgcggatgcgtccaaagagttgttgttgttctgtagattgcatgctgctcttgtctctgtcgtcgtccttagcttacggcgttacgccaatgggcggcggacaaggagctgaacgacgaccactctgtctggtggagacaaatatatacactatcacgtgattttcctctctttagctccatcctgatgtaacttggtaatttactccatccctccgtcattttttttgcaatagttctttt

SEQ ID NO: 384 - protein, 87 aa, Zea mays
  misc_feature (1)..(87): Ceres CLONE ID no. 336524
  misc_feature (1)..(87): Also Known As Ceres GEMINI ID no. 538C9
MSSGGRRGRISDDEINELISKLQALLPESSRRRNASRSSASKLLKETCAYVKSLHREVDDLSERLSGLMETMDNDSPQAEIIRSLLR

SEQ ID NO: 385 - protein, 92 aa, Arabidopsis thaliana
  misc_feature (1)..(92): Ceres CLONE ID no. 4734
  misc_feature (1)..(92): Functional Homolog of  Ceres CLONE ID no. 336524 at SEQ ID NO. 384 with e-value of 1.69E-19 and percent identity of 57.6
MSNRRSRQSSSAPRISDNQMIDLVSKLRQILPEIGQRRRSDKASASKVLQETCNYIRNLNREVDNLSERLSQLLESVDEDSPEAAVIRSLLM

SEQ ID NO: 386 - protein, 92 aa, Brassica napus
  misc_feature (1)..(92): Ceres CLONE ID no. 951040
  misc_feature (1)..(92): Functional Homolog of  Ceres CLONE ID no. 336524 at SEQ ID NO. 384 with e-value of 9.99E-20 and percent identity of 58.9
MSNRRSRQSSSAPRISDDQIIDLVTKLRQILPEIGQRRRSDKVSASKVLQETCNYIRNLNREVDNLSERLAQLLESVDEDSPQAAVIRSLLM

SEQ ID NO: 387 - protein, 91 aa, Glycine max
  misc_feature (1)..(91): Ceres CLONE ID no. 560681
  misc_feature (1)..(91): Also Known As Ceres GEMINI ID no. 537C3
  misc_feature (1)..(91): Functional Homolog of  Ceres CLONE ID no. 336524 at SEQ ID NO. 384 with e-value of 9.99E-20 and percent identity of 64.9
MSSRRSRQQSASTRISDDQIIDLVSKLRQLVPEIRDRRSDKVSASKVLQETCNYIRSLHREVDDLSERLSQLLATIDADSPEAAIIRSLIN

SEQ ID NO: 388 - protein, 86 aa, Zea mays
  misc_feature (1)..(86): Ceres CLONE ID no. 280170
  misc_feature (1)..(86): Functional Homolog of  Ceres CLONE ID no. 336524 at SEQ ID NO. 384 with e-value of 1.80E-36 and percent identity of 96.4
MSSGRRGRISDDEINELISKLQALLPESSRRRNASRSSASKLLKETCAYIKSLHREVDDLSERLSGLMSTMDNDSPQAEIIRSLLR

SEQ ID NO: 389 - protein, 88 aa, Oryza sativa subsp. japonica
  misc_feature (1)..(88): Public GI No. 31431968
  misc_feature (1)..(88): Functional Homolog of  Ceres CLONE ID no. 336524 at SEQ ID NO. 384 with e-value of 1.60E-28 and percent identity of 84.3
MSGRRASGRITDDEINELISKLQSLLPESSRRRGATSRSPATKLLKEMCSYIKSLHREVDDLSERLSELMATMDSNSPQADIIRSLLR

SEQ ID NO: 390 - DNA, 1384 bp, Zea mays
  misc_feature (1)..(1384): Ceres CLONE ID no. 336888
  misc_feature (1)..(1384): Also Known As Ceres CDNA ID no. 23767148
  misc_feature (1)..(1384): Also Known As Ceres GEMINI ID no. 538H7
attacatccgagggcactccatctcttgcgtcccttaacccctccaccaatccaatccaatcccttaaccccgcaccgaatccagccttcgaagcttcctcttcctcccggccccggtcccggtcccggtcccggagccctgttcttggtacttaggacaagacgctccgagaccctcgagattgagagctcgctcgctcgctcggtgtcttcgccagctgcccaccctccttcctgctcgtccccccgctcgcgcctcctcttcctcggactgatgggcgaccatctcgcgttgatcgtggaccggctgctgacagagtcgacgctggaggcggcgatcggcggtgggaagcacatggtcgatctgcgtcaggagacggtggacgtcgagtactgccatcgcgggctaggcggcggctcggcgacgaaggtggtggagtgcaggatttgccaggaggaggactgggacacctgcatggaggccccctgcgcctgttgtggcagcctcaagtatgcgcatcggaaatgcattcagcgctggtgcaatgagaaaggcgacactatgtgtgaaatatgcctgcagcaattcaggccaggttatacttctccacaacagctgtttcactatggaagtataccaatgaatttcagagggaactgggagattgccaggcaagatctcaatgattcccagataataacaatgatgcccacggagcgtgattttatggacaattacgatgactactttcctatcaggacaagaagcagcaccttgtgttgccggacaattgccataattttcatgtcactcctggtccttcgccacactcttcctcttgtgattggtgacaatggggagtactcattggccttattctcgcttctggtgctgagaactgcgggaatcctctttccaatcctggtgatggtgagagcattggcaagcttccatcatcgacggcggcagcaggaaagccaggaagcatatatatcttcatcagagagcgaggaggaagaggaagagtatacagttgccaattctgcacaaacaaactactcgcaaccgcgcttcataccagtctactgacatggccaagaacaagccttccaacctcacatctgacagggaattccagcgcctgagtttagctgacagatgcaaggatgaatggatgatcacaaggggggaaattacaaaattgtgaatgtggtgacatagtaagatagcctgaagccactcgcttctatgcccatagagaagaatgtagtggccctgctacttgtacataggagagagtacagcagcagagtgctgacaaacccggatactgtgactcgagtctctactgcagtaacccttgtgcactgctctccccgtccc

SEQ ID NO: 391 - protein, 271 aa, Zea mays
  misc_feature (1)..(271): Ceres CLONE ID no. 336888
  misc_feature (1)..(271): Also Known As Ceres CDNA ID no. 23767148
  misc_feature (1)..(271): Also Known As Ceres GEMINI ID no. 538H7
  misc_feature (56)..(101): Pfam Name: zf-C3HC4 Pfam Description: Zinc finger, C3HC4 type (RING finger)
MGDHLALIVDRLLTESTLEAAIGGGKHMVDLRQETVDVEYCHRGLGGGSATKVVECRICQEEDWDTCMEAPCACCGSLKYAHRKCIQRWCNEKGDTMCEICLQQFRPGYTSPQQLFHYGSIPMNFRGNWEIARQDLNDSQIITMMPTERDFMDNYDDYFPIRTRSSTLCCRTIAIIFMSLLVLRHTLPLVIGDNGEYSLALFSLLVLRTAGILFPILVMVRALASFHHRRRQQESQEAYISSSESEEEEEEYTVANSAQTNYSQPRFIPVY

SEQ ID NO: 392 - protein, 259 aa, Arabidopsis thaliana
  misc_feature (1)..(259): Public GI No. 46931308
  misc_feature (1)..(259): Functional Homolog of  Ceres CLONE ID no. 336888 at SEQ ID NO. 391 with e-value of 4.59E-56 and percent identity of 48.5
MGDHFVLLVDRLITESTIEAAIQSRNQMLQANIPVEECTILDDKTLEMLRNGDLSMAECRICHDEDLDSNMETPCSCSGSVKYAHRRCVQRWCNEKGDTTCEICHQEFKPDYTAPPPLLELGHVPLHFRGNWGISQREHRFITVVPADSTFIDQPYPLSSTTSFICCRSLVLIFMALLILRHTLPLVLTGSNLHVFPLFTLLFLRILGIMLPIYVVTKAVATCRRHSRTLDTSPSDDSSDEETDSWRLPQTQSYIIGVR

SEQ ID NO: 393 - DNA, 556 bp, Arabidopsis thaliana
  misc_feature (1)..(556): Ceres CLONE ID no. 34060
  misc_feature (1)..(556): Also Known As Ceres CDNA ID no. 23368585
  misc_feature (1)..(556): Also Known As Ceres GEMINI ID no. 535B6
ccgggtagttctaactttttgaccctaaaacgaaagacccttctctagcacgtcggggttcgttcaaagatcaagatctgcagacatggcggacgaagcaaccagagctgcttttatggagattcaagctagcatgattgaactcactgggaagctcaaacaggtgcagaatcagatgcgcaacaaagagggagatagaaagcgagctttcttaaccttggaggagctgaggccattgcctgaagagacaaacacctacaagtcaataggaagaacgtttgttctagagcccaagacagtgctggagggtgaacaagagcaaaaactcaaggacagtgaagctgccgttgcttctctacagacatccaaggaatacttggagaagcaggtagcagaggttgagaacaacttgagggagctgttgcagcaagaaccgggcattgctcaacagattatgtccatgtctatgtaacttttgtattatcccaaacctttgagtttggagagcttttgggattgaaaccataacatgttctagttaaaagttgtaacattc

SEQ ID NO: 394 - protein, 128 aa, Arabidopsis thaliana
  misc_feature (1)..(128): Ceres CLONE ID no. 34060
  misc_feature (1)..(128): Also Known As Ceres CDNA ID no. 23368585
  misc_feature (1)..(128): Also Known As Ceres GEMINI ID no. 535B6
  misc_feature (11)..(116): Pfam Name: KE2 Pfam Description: KE2 family protein
MADEATRAAFMEIQASMIELTGKLKQVQNQMRNKEGDRKRAFLTLEELRPLPEETNTYKSIGRTFVLEPKTVLEGEQEQKLKDSEAAVASLQTSKEYLEKQVAEVENNLRELLQQEPGIAQQIMSMSM

SEQ ID NO: 395 - protein, 129 aa, Glycine max
  misc_feature (1)..(129): Ceres CLONE ID no. 810464
  misc_feature (1)..(129): Functional Homolog of  Ceres CLONE ID no. 34060 at SEQ ID NO. 394 with e-value of 4.39E-42 and percent identity of 67.9
MADEANRTAFLEIQSRMIDTTGKIKQVQTQMRSKEAEKKRAFLTMEELKQVPDDTNVYKSIGRMFVLETKATLMNEQETKFKDGEASITALQSSKEYLEKQMAEVETNLRELLQQDPGLARQIMSMNVV

SEQ ID NO: 396 - DNA, 1240 bp, Arabidopsis thaliana
  misc_feature (1)..(1240): Ceres CLONE ID no. 34183
  misc_feature (1)..(1240): Also Known As Ceres GEMINI ID no. 555F1
acatctggaaaaacttggatctggagaaactttgttcacctttttatttccgatcaaaattagggttcagagcatttccaagagcacaagaagttgacgacaatgaacacaagaggaaattactctaatggttttacttcaaagttctttaaaccgtaccttcctagtgaatccggtgatgatctggtactacccatttctttcaacagctgtttaccaaagtctttgcctaaaactgtaactgttagaagcatttctgaaaacatttggaaattagggtttaagaaatgtggtggtgaggttgagagatttgttatggttagtggttggaagaagattgtaagggacgaaaacctgaacggtggagatctcttgtcatttgagtttgatggctctcatttttttaatttctgtatctttgaccatgagactacgtgtaagaggcttaagagaagttcagagcaaagcaaggacatcatcaaagtgggatctgattgtgaagaagaatctcaggctagtgatgatgttatcgttcttaatagtgatgattctgacgattctgataatgattattctgttgaggatgataatgttgctgaggatgatgatggtcttgaggatgaagtagatgttgaggctgaggatggttatgatgctaaggatagtgatggtcttgaggatgaagatgatgatgaggctgaggatggttatgatgctaaggatgatgatggtcttgaggatgaagatgatcttgaggatgaggatgacgaaaggcggtatctggatgatcacgagaacccgtactttactatgacactcaatccgaagaagaagagccaattgcacataccggctcatgtcataagggactatgacttaaccttcccggagcgtataacagtcgtggacgaaatgggagcattggagaaagcaatcaagattcaaaagaatggttgcatctttgtcaagggatttggtagtttcatcagaaggaacaaaatgaagatgactgacaaaatgatatgcgagcttaagaggactggaggtaatctggttcacaccatcaaggtcaagattatcagcggatgatctcttcactaagcttttgtgagtcttatgtgtcttagctgtgagtggtttttattatgttactaatggtaaaatgtctatcttaggatttggtttataactaaggatttgggcgtgagagatgttttcatgttgaattaagactttctat

SEQ ID NO: 397 - protein, 328 aa, Arabidopsis thaliana
  misc_feature (1)..(328): Ceres CLONE ID no. 34183
  misc_feature (1)..(328): Also Known As Ceres GEMINI ID no. 555F1
  misc_feature (14)..(111): Pfam Name: B3 Pfam Description: B3 DNA binding domain
MNTRGNYSNGFTSKFFKPYLPSESGDDLVLPISFNSCLPKSLPKTVTVRSISENIWKLGFKKCGGEVERFVMVSGWKKIVRDENLNGGDLLSFEFDGSHFFNFCIFDHETTCKRLKRSSEQSKDIIKVGSDCEEESQASDDVIVLNSDDSDDSDNDYSVEDDNVAEDDDGLEDEVDVEAEDGYDAKDSDGLEDEDDDEAEDGYDAKDDDGLEDEDDLEDEDDERRYLDDHENPYFTMTLNPKKKSQLHIPAHVIRDYDLTFPERITVVDEMGALEKAIKIQKNGCIFVKGFGSFIRRNKMKMTDKMICELKRTGGNLVHTIKVKIISG

SEQ ID NO: 398 - DNA, 1195 bp, Arabidopsis thaliana
  misc_feature (1)..(1195): Ceres CLONE ID no. 34406
  misc_feature (1)..(1195): Also Known As Ceres CDNA ID no. 23380594
  misc_feature (1)..(1195): Also Known As Ceres GEMINI ID no. 553C4
ataagatccaaaaccataaaactaggtttcacactttctctctaaacactgtctcttttctccgatacatatcccgccgcttcccctgtgtttttcttcgccgtccgtcgttcttttcaactccttagctgcgatattaaagtctagacacaatgagaggaaggagctacacgccatcaccaccaaggggttatggaaggaggggccggagccctagccctcggggccggtttggtgggagtcgtgacagtgatctcccaaccagtcttttggttcgcaacttacgtcatgattgcaggcaagaagacctcaggaggccatttgagcagtttggtcccgtcaaggacatctaccttcctagggattactatactggagatccaagggggtttggattcattcagtttatggatcctgctgatgctgctgaggctaaacatcaaatggatggttatcttcttcttggtcgtgagttgactgtcgtatttgctgaagaaaaccggaagaagccaactgagatgagaacaagggatcgaggtggaaggagcaacagattccaggacagaagacgttctcctcctcggtactctcggtctcctcctcgccgtggtcgtagatcacgatcacgtagctgcggctataattctcctcccgctaaaagacatcaatctaggtctgtctcacctcaggatagacgatatgagaaggagaggtcatactctcgctcaccaccccataatggctcaagggttcgcagtggaagtcctgggagagtgaagagccacagcagaagcccaagaagaagcgtgagcccaagaaaaaacaggagctacacgccagaacaagcaaggagccaaagccctgtccctaggcagagcaggagcccgaccccagtccctcgtggagcacaaaatggagaccgttctccaagccagtgatttaacaccatgtatctctctactcttcagtttttcagtcttgttctgtttgatcagatattttgtttgcctcagattgatatttccctacttagacagatatttgtagtgctattggtattttgctttatgtttgatccatggatgatcttgagacagtattttgaagtagcatgtgttatttgtcatcttatctttttagatctcatctaacattgttatggtgaaaaagatggtcctattacgggagctttttg

SEQ ID NO: 399 - protein, 261 aa, Arabidopsis thaliana
  misc_feature (1)..(261): Ceres CLONE ID no. 34406
  misc_feature (1)..(261): Also Known As Ceres CDNA ID no. 23380594
  misc_feature (1)..(261): Also Known As Ceres GEMINI ID no. 553C4
  misc_feature (39)..(110): Pfam Name: RRM_1 Pfam Description: RNA recognition motif. ( a.k.a. RRM, RBD, or RNP domain)
MRGRSYTPSPPRGYGRRGRSPSPRGRFGGSRDSDLPTSLLVRNLRHDCRQEDLRRPFEQFGPVKDIYLPRDYYTGDPRGFGFIQFMDPADAAEAKHQMDGYLLLGRELTVVFAEENRKKPTEMRTRDRGGRSNRFQDRRRSPPRYSRSPPRRGRRSRSRSCGYNSPPAKRHQSRSVSPQDRRYEKERSYSRSPPHNGSRVRSGSPGRVKSHSRSPRRSVSPRKNRSYTPEQARSQSPVPRQSRSPTPVPRGAQNGDRSPSQ

SEQ ID NO: 400 - protein, 220 aa, Arabidopsis thaliana
  misc_feature (1)..(220): Public GI No. 12323160
  misc_feature (1)..(220): Functional Homolog of  Ceres CLONE ID no. 34406 at SEQ ID NO. 399 with e-value of 1.20E-87 and percent identity of 80.6
MRGRSYTPSPPRGYGRRGRSPSPRGRYGGRSRDLPTSLLVRNLRHDCRQEDLRKSFEQFGPVKDIYLPRDYYTGDPRGFGFVQFMDPADAADAKHHMDGYLLLGRELTVVFAEENRKKPTEMRARERGGGRFRDRRRTPPRYYSRSRSPPPRRGRSRSRSGDYYSPPPRRHHPRSISPREERYDGRRSYSRSPASDGSRGRSLTPVRGKSRSLTPALEEA

SEQ ID NO: 401 - protein, 208 aa, Parthenium argentatum
  misc_feature (1)..(208): Ceres CLONE ID no. 1604448
  misc_feature (1)..(208): Functional Homolog of  Ceres CLONE ID no. 34406 at SEQ ID NO. 399 with e-value of 2.40E-73 and percent identity of 74.4
  misc_feature (179)..(179): Xaa is any aa, unknown, or other
  misc_feature (180)..(180): Xaa is any aa, unknown, or other
MGGRSYSPSPPRGGRYARRGRSPSPRGRYGGGSRGRDLPTSLLVRNLRLDCRPEDVRRPFGEFGPLKDVYLPRDYYSGEPRGFGFVQFVDPADAAEAKYQMDGQVFQGRELTVVFAEENRKKPSDMRSRERRGGGGSRYSDRRRSPPRRYSPPPRHARSRSRSRDYSPPPKRRHQSRSXXPRGKRYSRERSYSRSPVRAHSPPYNVGV

SEQ ID NO: 402 - DNA, 1193 bp, Arabidopsis thaliana
  misc_feature (1)..(1193): Ceres CLONE ID no. 34589
  misc_feature (1)..(1193): Also Known As Ceres GEMINI ID no. 535F5
ataaaagaccattctacttctatatatatatatagtgtgagtgagacagagcctcacataaataaaaagtctcctaatctgaatacaactattactaacaataattcacttatctaaagaccatcatctgactgactctacgctgaatcatcacgaggaagaacttgaatcgaccggagaagagatacgtgtagagatctgattggctcaccggagagcaacaaaacaagaaatggggaggacgacgtggttcgacgttgacgggttgaggaaaggagagtggacggcggaggaagaccggaagctcgtggtttacatcaacgaacacggtctaggcgagtggggttcactgcctaagagagccggtctacaaagatgtggaaagagttgtagattaagatggctgaattatttgaggcctgggattaaaagaggcaagttcactcctcaggaggaagaagaaatcatcaaataccatgctcttcttggaaacaggtgggcagcaatagctaagcaaatgccaaacagaacagacaataacataaagaaccattggaactcatgccttaagaaaagacttgctaaaaaaggaatcgatccaatgacccatgagccaacaacaacaacaagcctcaccgtcgatgtcacctcctcatcaactacgtcgtctcctacaccgagccctacttcttcttctttttcctcctgttcctctactggctctgcacgtttccttaacaagctcgctgctggaatctcgtcaagaaaacacggactagagagtatcaagacagtgatattggcagaacaaccaagagaagccgttgatgaagagaagatgatgacaattaacatgaaagagaaggaattgattagttgttacatggagattgatgagacgatgagtattgatgaactaccttgtgatgactcgacgtctggcttcgtggcttttgacgactactcattaatcgacccatacagagacagtgtgtacgtatctgatttctacgatgagactgaacaccttgacctgttccttctttgaatcacatttcctttgtctaaataaatccgcttctttagtgtgacgagagagacagtggagagagatgtctgaaaaaaacaagtgctgattagtactttgaatgacatgcatggtcaatgttgttttacagctttgagcctttgac

SEQ ID NO: 403 - protein, 271 aa, Arabidopsis thaliana
  misc_feature (1)..(271): Ceres CLONE ID no. 34589
  misc_feature (1)..(271): Also Known As Ceres GEMINI ID no. 535F5
  misc_feature (67)..(112): Pfam Name: Myb_DNA-binding Pfam Description: Myb-like DNA-binding domain
MGRTTWFDVDGLRKGEWTAEEDRKLVVYINEHGLGEWGSLPKRAGLQRCGKSCRLRWLNYLRPGIKRGKFTPQEEEEIIKYHALLGNRWAAIAKQMPNRTDNNIKNHWNSCLKKRLAKKGIDPMTHEPTTTTSLTVDVTSSSTTSSPTPSPTSSSFSSCSSTGSARFLNKLAAGISSRKHGLESIKTVILAEQPREAVDEEKMMTINMKEKELISCYMEIDETMSIDELPCDDSTSGFVAFDDYSLIDPYRDSVYVSDFYDETEHLDLFLL

SEQ ID NO: 404 - DNA, 557 bp, Arabidopsis thaliana
  misc_feature (1)..(557): Ceres CLONE ID no. 35429
  misc_feature (1)..(557): Also Known As Ceres GEMINI ID no. 536H6
attctcgtctttagcaaaatctcaaaagacaaaaagatattgatgtctctccaacgacccaatgggaactcgagttcgtcttcttcccacaagaagcacaaaactgcagctggatcaacatgtgttctaagcagcagcgccgacgatggagtcaacaatccggagcttgaccagactcaaaatggagtctctacagctaaacgccgccgtggaagaaaccctgttgataaagaatatagaagcctcaagagattattgaggaacagagtatcagcgcaacaagcaagagagaggaagaaagtgtatgtgagtgatttggaatcaagagctaatgagttacagaacaacaatgaccagctcgaagagaagatttctactttgacgaacgagaacacaatgcttcgtaaaatgcttattaacacaaggcctaaaactgatgacaatcactaaatatttaccctttaatccattgttcagtgttgtatgattatctttctttcttttttggttttggtttgtatacactttttgttcgaataacattcactttgagcatc

SEQ ID NO: 405 - protein, 135 aa, Arabidopsis thaliana
  misc_feature (1)..(135): Ceres CLONE ID no. 35429
  misc_feature (1)..(135): Also Known As Ceres GEMINI ID no. 536H6
  misc_feature (62)..(116): Pfam Name: bZIP_2 Pfam Description: Basic region leucine zipper
MSLQRPNGNSSSSSSHKKHKTAAGSTCVLSSSADDGVNNPELDQTQNGVSTAKRRRGRNPVDKEYRSLKRLLRNRVSAQQARERKKVYVSDLESRANELQNNNDQLEEKISTLTNENTMLRKMLINTRPKTDDNH

SEQ ID NO: 406 - protein, 191 aa, Glycine max
  misc_feature (1)..(191): Ceres CLONE ID no. 539578
  misc_feature (1)..(191): Functional Homolog of  Ceres CLONE ID no. 35429 at SEQ ID NO. 405 with e-value of 2.59E-31 and percent identity of 75.5
MSLPRPSEGKAPSQLKEGVAPAAAEASTSSSWNNRLNTFPPLSLHNKNSKIEDSDEDMFTVPDVEATPINVHSAVTLQNSNLNQRNVTDPQFQSGFPGKRRRGRNPADKEHRRLKRLLRNRVSAQQARERKKVYVNDLESRAKEMQDKNAILEERISTLINENTMLRKVLMNARPKNDDSIEQKQDQLSKS

SEQ ID NO: 407 - DNA, 1636 bp, Arabidopsis thaliana
  misc_feature (1)..(1636): Ceres CLONE ID no. 35786
  misc_feature (1)..(1636): Also Known As Ceres CDNA ID no. 23381009
  misc_feature (1)..(1636): Also Known As Ceres GEMINI ID no. 534B6
acttccttttgttccccaaattctcgaaatcgaaacacgacttaaaacgaaaaagacgagacttttaacactcagacctaaaccaacactcttcctctttctatctctctctcgccgatcggaagcagatttttctcaaaaggatggattcaacgaagcttagtgagctaaaggtcttcatcgatcaatgcaagtctgacccttcccttctcactactccttcactctccttcttccgtgactatctcgagagtcttggtgctaagatacctactggtgtccatgaagaagacaaagacactaagccgaggagtttcgtagtggaagagagtgatgatgatatggatgaaactgaagaagtaaaaccgaaagtggaggaagaagaagaagaggatgagattgttgaatctgatgtagagcttgaaggagacactgttgagcctgataatgatcctcctcagaagatgggggattcatcagtggaggtgactgatgagaatcgtgaagctgctcaagaagctaagggcaaagccatggaggccctttctgaaggaaactttgatgaagcaattgagcatttaactcgggcaataacgttgaacccgacttcagctattatgtatggaaacagagctagtgtctacattaagttgaagaagccaaacgctgctattcgagatgcaaacgcagcattggagattaaccctgattctgccaagggatacaagtcacgaggtatggctcgtgccatgcttggagaatgggcagaggctgcaaaagaccttcaccttgcatctacgatagactatgatgaggaaattagtgctgttctcaaaaaggttgaacctaatgcacataagcttgaggagcaccgtagaaagtatgacagattacgtaaggaaagagaggacaaaaaggctgaacgggatagattacgtcgccgtgctgaagcacaggctgcctatgataaagctaagaaagaagaacagtcatcatctagcagaccatcaggaggcggtttcccaggaggtatgcccggtggtttcccaggaggtatgcccggtggattcccaggaggaatgggaggcatgcccggcggattcccgggaggaatgggtggtatgggcggtatgcccggtggattcccaggaggaatgggcggtggtatgcctgcaggaatgggcggtggtatgcccggaatgggcggtggtatgcctgctggaatgggtggtggcggtatgccaggtgcaggcggtggtatgcctggtggtggcggtatgcctggtggtatggacttcagcaaaatattgaatgatcctgagctaatgacggcatttagcgaccctgaagtcatggctgctcttcaagatgtgatgaagaaccctgcgaatctagcgaagcatcaggcgaatccgaaggtggctcccgtgattgcaaagatgatgggcaaatttgcaggacctcagtaaacaaaacaagaagcttgcttttctttgccaatttctgtgtttaattgcgtgagataagagatatgttggagaacttttgttttcttttatgttgtcgttgcagaggaactttaacaggaacaaaactcttttctcttcgttagtaatctaccctcttctcgtttttc

SEQ ID NO: 408 - protein, 441 aa, Arabidopsis thaliana
  misc_feature (1)..(441): Ceres CLONE ID no. 35786
  misc_feature (1)..(441): Also Known As Ceres CDNA ID no. 23381009
  misc_feature (1)..(441): Also Known As Ceres GEMINI ID no. 534B6
  misc_feature (123)..(156): Pfam Name: TPR_2 Pfam Description: Tetratricopeptide repeat
  misc_feature (157)..(190): Pfam Name: TPR_2 Pfam Description: Tetratricopeptide repeat
  misc_feature (191)..(221): Pfam Name: TPR_1 Pfam Description: Tetratricopeptide repeat
MDSTKLSELKVFIDQCKSDPSLLTTPSLSFFRDYLESLGAKIPTGVHEEDKDTKPRSFVVEESDDDMDETEEVKPKVEEEEEEDEIVESDVELEGDTVEPDNDPPQKMGDSSVEVTDENREAAQEAKGKAMEALSEGNFDEAIEHLTRAITLNPTSAIMYGNRASVYIKLKKPNAAIRDANAALEINPDSAKGYKSRGMARAMLGEWAEAAKDLHLASTIDYDEEISAVLKKVEPNAHKLEEHRRKYDRLRKEREDKKAERDRLRRRAEAQAAYDKAKKEEQSSSSRPSGGGFPGGMPGGFPGGMPGGFPGGMGGMPGGFPGGMGGMGGMPGGFPGGMGGGMPAGMGGGMPGMGGGMPAGMGGGGMPGAGGGMPGGGGMPGGMDFSKILNDPELMTAFSDPEVMAALQDVMKNPANLAKHQANPKVAPVIAKMMGKFAGPQ

SEQ ID NO: 409 - protein, 399 aa, Zea mays
  misc_feature (1)..(399): Ceres CLONE ID no. 288714
  misc_feature (1)..(399): Functional Homolog of  Ceres CLONE ID no. 35786 at SEQ ID NO. 408 with e-value of 0.0 and percent identity of 71.9
MDASKLRELRDFVEACKKNPSLLADPNLSFFRDYLQSLGAKIPAAAPSFESPKRSSMDDIDDDGDDDDDLDMRDPTPERDELDEEIVESDLELEGEIVQSDHDDPPQKMGNPSVEVTEENRDASQEAKGKAMEAISEGKLEDAIEHLTNAIVLNPLSAIMYGTRASVFIKMKKPAAAIRDANAALEINPDSAKGYKTRGMAYAMLGKWEEAAHDLHTASNMDYDEEINAVLKKVEPNAHKIVEHRRKYERLRKEREEKRAQRDRLRQRAEAQAAYDKAKRKEQSSSRSSGGASPRGFPGGMPGGGFPRGMPGGGFPGGGMPGGFPGGGMPGGFPGGVPGNVDMSKILNDPDLMAAFSDPEVMAALQDVMNNPANFAKHQANPKVGPIIAKMMAKFNGSQ

SEQ ID NO: 410 - protein, 408 aa, Oryza sativa subsp. japonica
  misc_feature (1)..(408): Public GI No. 50904559
  misc_feature (1)..(408): Functional Homolog of  Ceres CLONE ID no. 35786 at SEQ ID NO. 408 with e-value of 0.0 and percent identity of 71.7
MDASRVGELRTFVEACKKDPSLLADPNLAFFRDYLESLGAHLPAAAFTKATPKPKPSSMDDIDDEYDDDDDDDLNMRDATPEPDELDQDIVESDLELEGDIVESDHQDPPQKMGDPSIDVTEENRDASQEAKSKAMEAMSEGKLEEAIDHLTKAILLNPLSAIMYGTRASVFIKMKKPVAAIRDANAALEINPDSAKGYKTRGMAYAMLGKWEEAAHDLHTASNMDYDDEINAVLKKVEPNAHKIMEHRRKYERLRKEREEKRAERDRFHRRAEAQAAYDKAKRKEQSSSRSSGGASPRGGFPGGMPGGGFPGGMPGGGFPGGMPGGGFPGGMPGGFPGGAMPGGVPGNVDMSKILNDPDLMAAFGDPEVMAALQDVMNNPASFARHQANPKVGPIIAKMMAKFNGSQ

SEQ ID NO: 411 - DNA, 1416 bp, Zea mays
  misc_feature (1)..(1416): Ceres CLONE ID no. 362309
  misc_feature (1)..(1416): Also Known As Ceres CDNA ID no. 23796210
  misc_feature (1)..(1416): Also Known As Ceres GEMINI ID no. 538E12
agcattttaacatcgtttgaagtaggaacctcacccagattcattgaaccgccagctctgccatcttatccttgccacgtgaagtgacgttcttggcgaccccatcaatctcctcgatttggatgtccacgagcttattgagctgttgctcctgcgtcctgagatcctctggctgctgctcaacagtttgttcatcctcatccccaatctcatgtgtccaatacacagcaaaagatgcctccttattgaaactggttggcatctgcaacagacgcttcctgttagttccagaggcactgccaaggatctcccccttcatgaggtcatatatgcaggccctgaagttgtccatgctcttatgatcctgagagtcgaggcttaggaagatcagaatttcccagcaccggaggaactgtttcttctttatcttcagcttctaacgaacagtctccatcaggtcagccggtggaaccattctcaaactttgggccctttttgacaggttggtctccttcagagacgagacaatagcaccaagtgcaggtttgatcggatcaaacatgagcaaacggaggcagtcaacggatgatctcacatactgcaggtcaagaagcggaaggcgcgggtgcctctcgacgtcgccgacgccgtgatggagccagtacggcggtccggccggctcgccaacctcccggataagcccgtgtaccgcgagaaggttcccgattttgggatgaagattaggaggacgtacggatcggtgagaagagatctgaccaaccgggtgtacgcgaccgacgatgcgaggagctacgccatctctaargcggaggatctggagcaagagctggactccagcttccccatcttcatcaagcccatgacccagtcccatgtcaccgggggcttctggctgggccttccgattcatttctgccggaagtatctgcccaagcgtgacgagatgatcaccctggtggatgaggatgatgacgagtccgacacgctgtacctcgcaatgaagcgggggctcagtgctggatggagagggtttgccgtccagcagaagctggtggatggagattgcctggtcttccagctgattgagcaaacaaagttcaaggtctacataactagagcaagttcctactacgaaagcgaggactgatgaaactagtagcttgtaatctggtgattggagctcagttatggaggtggctgcgttggacaagcttgcatctgggaatcgctggggtgtcttgaaactttttggtggcagaaagttagctgatgtatgaaacccagtatctcctaccaattgttgctgatttgtgtacttcttgggcttaccacttgcacggttcagaaacctgcactatgtaagggggttgttggtggcagctaacctcgttttgt

SEQ ID NO: 412 - protein, 171 aa, Zea mays
  misc_feature (1)..(171): Ceres CLONE ID no. 362309
  misc_feature (1)..(171): Also Known As Ceres CDNA ID no. 23796210
  misc_feature (1)..(171): Also Known As Ceres GEMINI ID no. 538E12
  misc_feature (72)..(166): Pfam Name: B3 Pfam Description: B3 DNA binding domain
MEPVRRSGRLANLPDKPVYREKVPDFGMKIRRTYGSVRRDLTNRVYATDDARSYAISKAEDLEQELDSSFPIFIKPMTQSHVTGGFWLGLPIHFCRKYLPKRDEMITLVDEDDDESDTLYLAMKRGLSAGWRGFAVQQKLVDGDCLVFQLIEQTKFKVYITRASSYYESED

SEQ ID NO: 413 - protein, 233 aa, Triticum aestivum
  misc_feature (1)..(233): Ceres CLONE ID no. 887276
  misc_feature (1)..(233): Functional Homolog of  Ceres CLONE ID no. 362309 at SEQ ID NO. 412 with e-value of 7.69E-54 and percent identity of 67.4
MAGAIAYEEQRRRQVEENQRKLEELKLRHLSAAVREAATPKPSPAKSLKRKRVPREAGEDAPIRRSGRVASLPEQPNYRFEDVFHVLEKKIRRGRRTTTSTRSDLINRVYATDKAREYATTMAEELQAKLGSRYPSFVKPMTQSHVTGGFWLGLPLPFCRKHLPKRDEKLTLKDEQGVESESLYLALKNGLSAGWRGFAIQHNLVDGDCLVFELINRTMFKVYVIRQSSYYER

SEQ ID NO: 414 - protein, 237 aa, Oryza sativa subsp. japonica
  misc_feature (1)..(237): Public GI No. 51091016
  misc_feature (1)..(237): Functional Homolog of  Ceres CLONE ID no. 362309 at SEQ ID NO. 412 with e-value of 2.19E-65 and percent identity of 72.7
MIEAESQMAEAASYEEQRRRQVEANKRKLEELRLHHLSAAVRESASKPSPVKQRKRKARALPGAGEDAPLRRSGRVANLPEKPKYRDEFQDFEKRIRRSYGGKRRDLSNRVYATDEQRDYAINAAQELEEELGSDYPIFVKPMLQSHVTGGFWLSLPTHFSRKYLPKRDETIRLVDEEDDEFDTLYLANKRGLSGGWRGFSIAHKLVDGDCLVFQLIQRTKFKVYIIRASSYYETDD

SEQ ID NO: 415 - DNA, 969 bp, Arabidopsis thaliana
  misc_feature (1)..(969): Ceres CLONE ID no. 36272
  misc_feature (1)..(969): Also Known As Ceres CDNA ID no. 23427841
  misc_feature (1)..(969): Also Known As Ceres GEMINI ID no. 531H5
aagattttccagatcttaaattctctcctcccccaattccatcttcgcaaattctccagattcttccgtcaatctttgagtttggtagagaaatggatcaacaaggacaatcatcagctatgaactatggttcaaacccatatcaaaccaacgccatgaccactacaccaaccggttcagaccatccagcttaccatcagatccaccagcaacaacaacaacagctcactcaacagcttcaatctttctgggagactcaattcaaagagattgagaaaaccactgatttcaagaaccatagccttccattggcaagaatcaagaaaatcatgaaagctgatgaagatgtgcgtatgatctcggccgaggcgcctgttgtgttcgccagggcctgcgagatgtttattctggagcttacgttaaggtcttggaaccatactgaggagaacaagagaaggacgttgcagaagaatgatatcgcggctgcggtgactagaactgatatttttgattttcttgtggatattgttcctcgggaggatcttcgtgatgaagtcttgggtggtgttggtgctgaagctgctacagctgcgggttatccgtatggatacttgcctcctggaacagctccaattgggaacccgggaatggttatgggtaacccgggcgcgtatccgccgaacccgtatatgggtcagccaatgtggcaacaaccaggacctgagcagcaggatcctgacaattagcttggcctaataaactagccgtctaattcgaagctctccccggtggatctactcaagaagaagaatgttaatagaaaactattgcgacataaaaagtttggtgtagtagaataatttctgttttatgatccatggatttatctattgttattcagtttggtttatcttgtcatcaaactgttttcggtcaatgtaacaaattcataaactgagaattgaactt

SEQ ID NO: 416 - protein, 217 aa, Arabidopsis thaliana
  misc_feature (1)..(217): Ceres CLONE ID no. 36272
  misc_feature (1)..(217): Also Known As Ceres CDNA ID no. 23427841
  misc_feature (1)..(217): Also Known As Ceres GEMINI ID no. 531H5
  misc_feature (63)..(138): Pfam Name: Histone Pfam Description: Core histone H2A/H2B/H3/H4
MDQQGQSSAMNYGSNPYQTNAMTTTPTGSDHPAYHQIHQQQQQQLTQQLQSFWETQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGGVGAEAATAAGYPYGYLPPGTAPIGNPGMVMGNPGAYPPNPYMGQPMWQQPGPEQQDPDN

SEQ ID NO: 417 - protein, 231 aa, Arabidopsis thaliana
  misc_feature (1)..(231): Ceres CLONE ID no. 1911
  misc_feature (1)..(231): Functional Homolog of  Ceres CLONE ID no. 36272 at SEQ ID NO. 416 with e-value of 5.89E-95 and percent identity of 88.0
MDQQDHGQSGAMNYGTNPYQTNPMSTTAATVAGGAAQPGQLAFHQIHQQQQQQQLAQQLQAFWENQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGSIPRGTVPEAAAAGYPYGYLPAGTAPIGNPGMVMGNPGGAYPPNPYMGQPMWQQQAPDQPDQEN

SEQ ID NO: 418 - protein, 231 aa, Arabidopsis thaliana; identical to SEQ ID NO: 417
  misc_feature (1)..(231): Public GI No. 23505813
  misc_feature (1)..(231): Functional Homolog of  Ceres CLONE ID no. 36272 at SEQ ID NO. 416 with e-value of 7.50E-95 and percent identity of 88.0

SEQ ID NO: 419 - protein, 231 aa, Arabidopsis thaliana
  misc_feature (1)..(231): Public GI No. 6289057
  misc_feature (1)..(231): Functional Homolog of  Ceres CLONE ID no. 36272 at SEQ ID NO. 416 with e-value of 3.19E-94 and percent identity of 87.5
MDQQDHGQSGAMNYGTNPYQTNPMSTTAATVAGGAAQPGQLAFHQIHQQQQQQQLAQQLQAFWENQFKEIEKTTDFKKHSLPLARIKKIMKADEDVRMISAEAPVVFARACEMFILELTLRSWNHTEENKRRTLQKNDIAAAVTRTDIFDFLVDIVPREDLRDEVLGSIPRGTVPEAAAAGYPYGYLPAGTAPIGNPGMVMGNPGGAYPPNPYMGQPMWQQQAPDQPDQEN

SEQ ID NO: 420 - protein, 208 aa, Arabidopsis thaliana
  misc_feature (1)..(208): Public GI No. 1922964
  misc_feature (1)..(208): Functional Homolog of  Ceres CLONE ID no. 36272 at SEQ ID NO. 416 with e-value of 1.19E-85 and percent identity of 88.1
MSTTAATVAGGAAQPGQLAFHQIHQQQQQQQLAQQLQAFWENQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGSIPRGTVPEAAAAGYPYGYLPAGTAPIGNPGMVMGNPGGAYPPNPYMGQPMWQQQAPDQPDQEN

SEQ ID NO: 421 - protein, 247 aa, Glycine max
  misc_feature (1)..(247): Ceres CLONE ID no. 573215
  misc_feature (1)..(247): Functional Homolog of  Ceres CLONE ID no. 36272 at SEQ ID NO. 416 with e-value of 3.90E-66 and percent identity of 70.6
MGVVGSGAQLAYGSNPYQPGQITGPPGSVVTSVGTIQSTPAGAQLGQHQLAYQHIHQQQQHQLQQQLQQFWSNQYQEIEKVTDFKNHSLPLARIKKIMKADEDVRMISAEAPVIFARACEMFILELTLRSWNHTEENKRRTLQKNDIAAAITRTDIFDFLVDIVPREDLKDEVLASIPRGTMPVAGPADALPYCYMPPQHASQVGAAGVIMGKPVMDPNMYAQQSHPYMAPQMWPQPPDQRQSSPEH

SEQ ID NO: 422 - protein, 260 aa, Glycine max
  misc_feature (1)..(260): Ceres CLONE ID no. 474481
  misc_feature (1)..(260): Functional Homolog of  Ceres CLONE ID no. 36272 at SEQ ID NO. 416 with e-value of 3.49E-65 and percent identity of 68.6
MDHQGHSQNPSMGVVGSGAQLAYGSNPYQPGQITGPPGSVVTSVGTIQSTGQPAGAQLGQHQLAYQHIHQQQQHQLQQQLQQFWSSQYQEIEKVTDFKNHSLPLARIKKIMKADEDVRMISAEAPVIFARACEMFILELTLRSWNHTEENKRRTLQKNDIAAAITRTDIFDFLVDIVPREDLKDEVLASIPRGTMPVAGPADALPYCYMPPQHPSQVGAAGVIMGKPVMDPNMYAQQSHPYMAPQMWPQPPDQRQSSPEH

SEQ ID NO: 423 - DNA, 1178 bp, Arabidopsis thaliana
  misc_feature (1)..(1178): Ceres CLONE ID no. 36927
  misc_feature (1)..(1178): Also Known As Ceres CDNA ID no. 23386077
  misc_feature (1)..(1178): Also Known As Ceres GEMINI ID no. 532E8
tttttcgaaattaaagaaaaccctaaacgccgttgtctgatattgagagagagagagagagagattaaaaacttcttctggttccttttatcaacattttttctctctcttaaaacttcgaagcgatttttgatttacagactatggaaatggaatcattcatggacgaccttttgaacttctctgtaccggaagaggaagaagacgacgacgaacatacgcaaccaccgaggaatattactcgccggaaaactggattacggccaacagactccttcggtctctttaataccgacgaccttggagtggttgaagaagaggatttgcaatggatttcaaacaaaaatgcttttccggtgattgaaacattcgtcggtgtattaccgtcggagcattttcctataacgtctcttctggaaagagaagcgactgaggtaaaacagctgagtccggtttcagtacttgagacgagtagccatagctccacaacgactacctcaaacagtagcggcggaagtaacggaagcacggccgtggctacgaccactaccactccaacaataatgagctgttgcgttggttttaaagcgccggctaaagcaagaagcaagcgtcgtcgtacaggacgccgtgatttacgagttttgtggacaggaaacgagcaaggaggaatacagaagaagaagacgatgactgtggcggcggctgcgttgattatgggaaggaagtgtcaacactgtggagcggagaagactccgcaatggagggcaggaccagcggggcctaagactctgtgtaacgcttgtggcgtgaggtataagtccgggaggctagttccggagtatcgtccagcgaacagtccaactttcacggcggagttacattcgaattctcaccggaagattgtagagatgaggaagcagtatcagtccggtgacggtgacggtgatcggaaagattgtggataaaaagtgattaggattaatttttattttttcggagaaactttttttttttttttttcgtttaatttctctttatttgtttttaaagtctgttttagggttttgcagttggaatttaggtttttaattttttgcttatcttttttatttgtgaaattagtggtaattacttatttagggaatattatggtcatggaatggaagataactttc

SEQ ID NO: 424 - protein, 274 aa, Arabidopsis thaliana
  misc_feature (1)..(274): Ceres CLONE ID no. 36927
  misc_feature (1)..(274): Also Known As Ceres CDNA ID no. 23386077
  misc_feature (1)..(274): Also Known As Ceres GEMINI ID no. 532E8
  misc_feature (196)..(231): Pfam Name: GATA Pfam Description: GATA zinc finger
MEMESFMDDLLNFSVPEEEEDDDEHTQPPRNITRRKTGLRPTDSFGLFNTDDLGVVEEEDLQWISNKNAFPVIETFVGVLPSEHFPITSLLEREATEVKQLSPVSVLETSSHSSTTTTSNSSGGSNGSTAVATTTTTPTIMSCCVGFKAPAKARSKRRRTGRRDLRVLWTGNEQGGIQKKKTMTVAAAALIMGRKCQHCGAEKTPQWRAGPAGPKTLCNACGVRYKSGRLVPEYRPANSPTFTAELHSNSHRKIVEMRKQYQSGDGDGDRKDCG

SEQ ID NO: 425 - protein, 289 aa, Nicotiana tabacum
  misc_feature (1)..(289): Public GI No. 37572445
  misc_feature (1)..(289): Functional Homolog of  Ceres CLONE ID no. 36927 at SEQ ID NO. 424 with e-value of 2.89E-45 and percent identity of 54.5
MKMEALDPSAASCFMVDVDDDLLNFSLEDETVFDDDEKTTKSITKHKHPLSSSYSSSLDSSNPVLSLLPSQQHPECVEEELEWLSNKDAFPAVEFGILADNPSIVFDHHSPVSVLENSSSTCNSSGNGSANANAYMSCCASLKVPVNYPVRARSKRRRRRQRGSFADLPSEHCMSVNKPSFKSVKQREPLLSLPLNSAKSASIGRRCQHCGADKTPQWRAGPLGPKTLCNACGVRYKSGRLLPEYRPANSPTFSPTVHSNSHRKVLEMRKQKIGVGGMMIHEACGYRVG

SEQ ID NO: 426 - DNA, 1782 bp, Zea mays
  misc_feature (1)..(1782): Ceres CLONE ID no. 374674
  misc_feature (1)..(1782): Also Known As Ceres CDNA ID no. 23799339
  misc_feature (1)..(1782): Also Known As Ceres GEMINI ID no. 539G9
tttttcctctccgatccggatctccccacccgctccggcgagccatcgccgcgtcgcctccacgcgaccgactacttctcatatcaatctatctatccggcttacccgccgccgcacgcaccaaggttgcgttcaccatattacctgtttgcttatcttctcccgagcccagcaaaccctagccgccgccacccatggacatagaggccgacggacgattcggcaacaaacgagtgcacaatcgcctaggcccgggctccggcggcgctccaccatctaccaacggaaaggtctgcaactactggcgtgccggtcggtgcaaccgctttccgtgccccttcctccacagcgagctccccgaggctgcgccgcccaagcgccccactggacccggggggaacgtatggcgcaaccccaacaccggaggacgaggaggtggccatcacaatagatgggggaagggcccaggagggggcagcgggattgcgagccacaagccgcctgagaggccctgcaagtactttctcgccggtaccgaatgtagctatggcgagaggtgccgctatccgcacagctactgcataagcgatagtatcgcgatgcttaccttgctcaagggacacgagcagggtgtcacgggcattgcactgcccgctgggtcagacaagctttattccgggagtaaggatggaactgttcgcatgtgggattgccaaactgggcagtgtgctggtgtcatcaccatgggtcgtgaggttgggtgtatgatcattgaaggtccgtggttatttgttggaatacctgatgcagtgaaggtttggaatatgcaaacagcagcggaaatgagccttactggaccaactgggcaagtctatgcactcgccgttgccagtgagttactctttgctgcaacacaagctgggaggattttagcatggagatttagtgccgcaactaactgttttgagccagctgcttctctagatggccataagcttgctgttgtttcattgatagtaggaggcatgaggctttattctgcttcaatggataaaactatcagagtatgggatttggcaactttgcagtgcatacagactctttctgatcataccgatgttgttatgtccgtgctttgctgggatcaatttctattatcttgctctttggatcaaacaataaaagtttgggccgctacagagagtggaaacttagaagtaacatatacacacaaagaggatcagggtgcacttgccctcagtggtatgcctgacgcacagtcaaaacctgtgctactgtgttcattaaatgacaacactgtccgcttatatgatctgccatcgttcagtgacagaggcagattattctccaaaaaagaaattagggcaatacagatgggtcctggtggtttattttttaccggggatggaactggtgagctcaaggtttggcagtgggtagatttagcccaaacctaatgaacatagtgtgctagattagttttctctcatgtattttatgagggagttcgtacaaatacgcataatgagttcaggttgtggtcggtggccagttctttttttgtaatatgccccacatttgtcacaaatgacacgagattcggtggatctgttcggcagtaaaatcagaagcagagtatgtgttatggactgtagttttgtcctggaatggattttaagacaggagaataattggttgttgtaatatgtaaggcactggaacgagcaattctgacgactgcttggaggtggtggcagtttc

SEQ ID NO: 427 - protein, 427 aa, Zea mays
  misc_feature (1)..(427): Ceres CLONE ID no. 374674
  misc_feature (1)..(427): Also Known As Ceres CDNA ID no. 23799339
  misc_feature (1)..(427): Also Known As Ceres GEMINI ID no. 539G9
  misc_feature (29)..(53): Pfam Name: zf-CCCH Pfam Description: Zinc finger C-x8-C-x5-C-x3-H type ( and similar)
  misc_feature (361)..(380): Pfam Name: WD40 Pfam Description: WD domain, G-beta repeat
MDIEADGRFGNKRVHNRLGPGSGGAPPSTNGKVCNYWRAGRCNRFPCPFLHSELPEAAPPKRPTGPGGNVWRNPNTGGRGGGHHNRWGKGPGGGSGIASHKPPERPCKYFLAGTECSYGERCRYPHSYCISDSIAMLTLLKGHEQGVTGIALPAGSDKLYSGSKDGTVRMWDCQTGQCAGVITMGREVGCMIIEGPWLFVGIPDAVKVWNMQTAAEMSLTGPTGQVYALAVASELLFAATQAGRILAWRFSAATNCFEPAASLDGHKLAVVSLIVGGMRLYSASMDKTIRVWDLATLQCIQTLSDHTDVVMSVLCWDQFLLSCSLDQTIKVWAATESGNLEVTYTHKEDQGALALSGMPDAQSKPVLLCSLNDNTVRLYDLPSFSDRGRLFSKKEIRAIQMGPGGLFFTGDGTGELKVWQWVDLAQT

SEQ ID NO: 428 - protein, 437 aa, Arabidopsis thaliana
  misc_feature (1)..(437): Public GI No. 10177733
  misc_feature (1)..(437): Functional Homolog of  Ceres CLONE ID no. 374674 at SEQ ID NO. 427 with e-value of 0.0 and percent identity of 62.5
MDFDLNGGNKRVFNRLGGGGGSTRPMAPTDTRQKVCFHWRAGRCNRSPCPYLHRELPGPGPGQGQGPGYTNKRVAEESGFAGPSHRRGPGFNGNSSSSWGRFGGNRTVTKTEKVCNFWVDGNCTYGDKCRYLHCWSKGESFALLTQLDGHEKLVSGIALPSGSDKLYTGSKDETLRVWDCASGQCTGVLKLGGEIGCVLSEGPWLLVGMPNLVKAWNIETNADQSLSGPVGQVYSLVVGTDLLFAGTQDGSILAWRYNAATNCFEPSASLTGHTLAVVTLYVGANRLYSGSMDKTIKVWSLDNLQCIQTLTDHSSVVMSLICWDQFLLSCSLDNTVKIWAAIEGGNLEVTYTHKEEHGVLALCGVHDAEAKPVLLCACNDNTLRLYDLPSFTERGKIFAKQEIRAIQIGPGGIFFTGDGTGQVKVWKWCTEPTAALP

SEQ ID NO: 429 - protein, 441 aa, Arabidopsis thaliana
  misc_feature (1)..(441): Ceres CLONE ID no. 18612
  misc_feature (1)..(441): Functional Homolog of  Ceres CLONE ID no. 374674 at SEQ ID NO. 427 with e-value of 0.0 and percent identity of 62.9
MDFDLNGGNKRVFNRLGGGGGVGGGSTRPMAPTDTRQKVCFHWRAGRCNRSPCPYLHRELPGPGPGQGQGPGYTNKRVAEESGFAGPSHRRGPGFNGNSSSSWGRFGGNRTVTKTEKVCNFWVDGNCTYGDKCRYLHCWSKGESFALLTQLDGHEKLVSGIALPSGSDKLYTGSKDETLRVWDCASGQCTGVLKLGGEIGCVLSEGPRLLVGMPNLVKAWNIETNADQSLSGPVGQVYSLVVGTDLLFAGTQDGSILAWRYNAATNCFEPAASLTGHTLAVVTLYVGANRLYSGSMDKTIKVWSLDNLQCIQTLTDHTSVVMSLICWDQFLLSCSLDNTVKIWAAIEGGNLEVTYTHKEEHGVLALCGVHDAEAKPVLLCACNDNTLRLYDLPSFTERGKIFAKQEIRAIQIGPGGIFFTGDGTGQVKVWKWCTEPTAALP

SEQ ID NO: 430 - protein, 430 aa, Arabidopsis thaliana
  misc_feature (1)..(430): Ceres CLONE ID no. 1359803
  misc_feature (1)..(430): Functional Homolog of  Ceres CLONE ID no. 374674 at SEQ ID NO. 427 with e-value of 0.0 and percent identity of 59.9
MDLDMNGGNKRVFQRLGGGSNRPTTDSNQKVCFHWRAGRCNRYPCPYLHRELPGPGSGPVAASSNKRVADESGFAGPSHRRGPGFSGTANNWGRFGGNRTVTKTEKLCKFWVDGNCPYGDKCRYLHCWSKGDSFSLLTQLDGHQKVVTGIALPSGSDKLYTASKDETVRIWDCASGQCTGVLNLGGEVGCIISEGPWLLVGMPNLVKAWNIQNNADLSLNGPVGQVYSLVVGTDLLFAGTQDGSILVWRYNSTTSCFDPAASLLGHTLAVVSLYVGANRLYSGAMDNSIKVWSLDNLQCIQTLTEHTSVVMSLICWDQFLLSCSLDNTVKIWAATEGGNLEVTYTHKEEYGVLALCGVHDAEAKPVLLCSCNDNSLHLYDLPSFTERGKILAKQEIRSIQIGPGGIFFTGDGSGQVKVWKWSTESTPILS

SEQ ID NO: 431 - DNA, 1192 bp, Arabidopsis thaliana
  misc_feature (1)..(1192): Ceres CLONE ID no. 37792
  misc_feature (1)..(1192): Also Known As Ceres CDNA ID no. 23361117
  misc_feature (1)..(1192): Also Known As Ceres GEMINI ID no. 552B11
aaagaaaaactatttaagaaacatatgttttggatcaagtaagggtttgatcttgtaccggaatcagatggatttgcctcctggttttaggtttcatccaacagacgaagaactcataacccactatctccacaagaaggttcttgaccttggtttctcggctaaagctattggtgaggttgatttgaacaaagctgagccatgggagttgccatataaagcaaaaattggtgagaaagaatggtactttttctgtgtgagggatagaaagtatccgactggtctgaggactaaccgagcaactcaagccggttattggaaggcgacagggaaggataaagaaatcttccgaggtaaatcgcttgttggtatgaagaaaacacttgttttctacagaggaagagctcctaaaggccagaaaacaaattgggtgatgcatgagtataggctagatggaaaactctctgctcacaacttgcctaaaaccgctaagaatgaatgggtgatctgcagggtatttcataaaactgctggaggtaagaagatcccgatttcgacgttaatccgaatcggttcttacggaaccgggtctagtttaccacctttaactgattcttcaccatacaacgacaaaaccaagaccgaaccagtttacgtgccctgcttctccaaccaagctgaaactagaggaacaatactcaattgcttcagcaacccttcccttagctccatccaaccagattttctccagatgattccactctaccaacctcaatctctcaacatttccgagagttccaatccggttcttacgcaagaacaatcagttttacaagcgatgatggaaaacaacagaaggcagaacttcaaaacattgagcatctcgcaagaaaccggggtttcgaacaccgataactcatcggtttttgaatttgggaggaagcgatttgatcatcaagaagttccatctccctcttccggtccggttgatcttgaacctttctggaattactgaagattcagaacctgaaaagtctattaatttaggtcacaagtaagaaaatctttgcaaagttttatccttttagcgtggtgtgctaagcttgtatagattattgacactacttcctgtattagtgtttkatattattatatksaactaaagttaatattagagaggataaaatgaagc

SEQ ID NO: 432 - protein, 315 aa, Arabidopsis thaliana
  misc_feature (1)..(315): Ceres CLONE ID no. 37792
  misc_feature (1)..(315): Also Known As Ceres CDNA ID no. 23361117
  misc_feature (1)..(315): Also Known As Ceres GEMINI ID no. 552B11
  misc_feature (3)..(129): Pfam Name: NAM Pfam Description: No apical meristem (NAM) protein
MDLPPGFRFHPTDEELITHYLHKKVLDLGFSAKAIGEVDLNKAEPWELPYKAKIGEKEWYFFCVRDRKYPTGLRTNRATQAGYWKATGKDKEIFRGKSLVGMKKTLVFYRGRAPKGQKTNWVMHEYRLDGKLSAHNLPKTAKNEWVICRVFHKTAGGKKIPISTLIRIGSYGTGSSLPPLTDSSPYNDKTKTEPVYVPCFSNQAETRGTILNCFSNPSLSSIQPDFLQMIPLYQPQSLNISESSNPVLTQEQSVLQAMMENNRRQNFKTLSISQETGVSNTDNSSVFEFGRKRFDHQEVPSPSSGPVDLEPFWNY

SEQ ID NO: 433 - protein, 343 aa, Arabidopsis thaliana
  misc_feature (1)..(343): Ceres CLONE ID no. 12970
  misc_feature (1)..(343): Functional Homolog of  Ceres CLONE ID no. 37792 at SEQ ID NO. 432 with e-value of 0.0 and percent identity of 83.5
MFLGEETMETFCGFQKEEEQMDLPPGFRFHPTDEELITHYLHKKVLDTSFSAKAIGEVDLNKSEPWELPWMAKMGEKEWYFFCVRDRKYPTGLRTNRATEAGYWKATGKDKEIYRGKSLVGMKKTLVFYRGRAPKGQKTNWVMHEYRLEGKFSAHNLPKTAKNEWVICRVFQKSAGGKKIPISSLIRIGSLGTDFNPSLLPSLTDSSPYNDKTKTEPVYVPCFSNQTDQNQGTTLNCFSSPVLNSIQADIFHRIPLYQTQSLQVSMNLQSPVLTQEHSVLHAMIENNRRQSLKTMSVSQETGVSTDMNTDISSDFEFGKRRFDSQEDPSSSTGPVDLEPFWNY

SEQ ID NO: 434 - protein, 357 aa, Glycine max
  misc_feature (1)..(357): Public GI No. 62546191
  misc_feature (1)..(357): Functional Homolog of  Ceres CLONE ID no. 37792 at SEQ ID NO. 432 with e-value of 3.19E-94 and percent identity of 60.9
MENVSVLLCNKEKDQMDLPPGFRFHPTDEELISHYLYRKVTDTNFSARAIGEVDLNRSEPWDLPWKAKMGEKEWYFFCVRDRKYPTGLRTNRATESGYWKATGKDKEIFRGKSLVGMKKTLVFYKGRAPKGEKTDWVMHEYRLDGKFSFHNLPKTAKNEWVICRVFQKSSGVKRTHISGMMMLDSYGNEMVYSSSALPPLTDSSPSIGNNTKALSVTDSAYVPCFSNPIDVPRGIFDSLNNINISINSNTLYGVSSNHSFYNTQGVQLQAPPTLPLPSSSNHYLRAFLENQGNGSNMSNNGFEPEREMVSVSQKTSLSTDVKAEISSLGKRHFENQNNPIASAAAVAPMDLATLWNY

SEQ ID NO: 435 - DNA, 1262 bp, Arabidopsis thaliana
  misc_feature (1)..(1262): Ceres CLONE ID no. 38311
  misc_feature (1)..(1262): Also Known As Ceres GEMINI ID no. 531C6
aaagcaacaaaaacttaacccatttcttcttctttttttgtttctctctcacaaacacaacaaatatggaatacagctgtgtagacgacagtagtactacgtcagaatctctctccatctctactactccaaagccgacaacgacaacggagaagaaactctcttctccaccggcgacttcgatgcgtctctacagaatgggaagcggcggaagcagcgttgttttggattcagagaacggcgtcgagaccgagtcacgaaagcttccgtcgtcgaaatacaaaggcgttgtgcctcagcctaacggaagatggggagctcagatttacgagaagcatcagcgagtttggctcggtactttcaacgaggaagaagaagctgcgtcttcttacgacatcgccgtgaggaggttccgaggccgcgacgccgtcactaacttcaaatctcaagttgatggaaacgacgccgaatcggcttttcttgacgctcattctaaagctgagatcgtggatatgttgaggaaacacacttacgccgatgagtttgagcagagtagacggaagtttgttaacggcgacggaaaacgctctgggttggagacggcgacgtacggaaacgacgctgttttgagagcgcgtgaggttttgttcgagaagactgttacgccgagcgacgtcgggaagctgaaccgtttagtgataccgaaacaacacgcggagaagcattttccgttatcggcgatgacgacggcgatggggatgaatccgtctccgacgaaaggcgttttgattaacttggaagatagaacagggaaagtgtggcggttccgttacagttactggaacagcagtcaaagttacgtgttgaccaagggctggagccggttcgttaaagagaagaatcttcgagccggtgatgtggtttgtttcgagagatcaaccggaccagaccggcaattgtatatccactggaaagtccggtctagtccggttcagactgtggttaggctattcggagtcaacattttcaatgtgagtaacgagaaaccaaacgacgtcgcagtagagtgtgttggcaagaagagatctcgggaagatgatttgttttcgttagggtgttccaagaagcaggcgattatcaacatcttgtgacaaattctttttttttggttttttttcttcaatttgtttctcctttttcaatattttgtattgaaatgacaagttgtaaattaggacaatacaagaaaaaatgacaactag

SEQ ID NO: 436 - protein, 322 aa, Arabidopsis thaliana
  misc_feature (1)..(322): Ceres CLONE ID no. 38311
  misc_feature (1)..(322): Also Known As Ceres GEMINI ID no. 531C6
  misc_feature (155)..(269): Pfam Name: B3 Pfam Description: B3 DNA binding domain
  misc_feature (31)..(92): Pfam Name: AP2 Pfam Description: AP2 domain
MRLYRMGSGGSSVVLDSENGVETESRKLPSSKYKGVVPQPNGRWGAQIYEKHQRVWLGTFNEEEEAASSYDIAVRRFRGRDAVTNFKSQVDGNDAESAFLDAHSKAEIVDMLRKHTYADEFEQSRRKFVNGDGKRSGLETATYGNDAVLRAREVLFEKTVTPSDVGKLNRLVIPKQHAEKHFPLSAMTTAMGMNPSPTKGVLINLEDRTGKVWRFRYSYWNSSQSYVLTKGWSRFVKEKNLRAGDVVCFERSTGPDRQLYIHWKVRSSPVQTVVRLFGVNIFNVSNEKPNDVAVECVGKKRSREDDLFSLGCSKKQAIINIL

SEQ ID NO: 437 - protein, 352 aa, Arabidopsis thaliana
  misc_feature (1)..(352): Ceres CLONE ID no. 19561
  misc_feature (1)..(352): Functional Homolog of  Ceres CLONE ID no. 38311 at SEQ ID NO. 436 with e-value of 7.90E-131 and percent identity of 78.6
MDSSCIDEISSSTSESFSATTAKKLSPPPAAALRLYRMGSGGSSVVLDPENGLETESRKLPSSKYKGVVPQPNGRWGAQIYEKHQRVWLGTFNEQEEAARSYDIAACRFRGRDAVVNFKNVLEDGDLAFLEAHSKAEIVDMLRKHTYADELEQNNKRQLFLSVDANGKRNGSSTTQNDKVLKTREVLFEKAVTPSDVGKLNRLVIPKQHAEKHFPLPSPSPAVTKGVLINFEDVNGKVWRFRYSYWNSSQSYVLTKGWSRFVKEKNLRAGDVVTFERSTGLERQLYIDWKVRSGPRENPVQVVVRLFGVDIFNVTTVKPNDVVAVCGGKRSRDVDDMFALRCSNKQAIINAL

SEQ ID NO: 438 - protein, 384 aa, Glycine max
  misc_feature (1)..(384): Ceres CLONE ID no. 597624
  misc_feature (1)..(384): Also Known As Ceres CDNA ID no. 23402435
  misc_feature (1)..(384): Also Known As Ceres GEMINI ID no. 531B11
  misc_feature (1)..(384): Functional Homolog of  Ceres CLONE ID no. 38311 at SEQ ID NO. 436 with e-value of 1.49E-111 and percent identity of 68.4
MDAISCLDESTTTESLSISQAKPSSTIMSSEKASPSPPPPNRLCRVGSGASAVVDSDGGGGGGSTEVESRKLPSSKYKGVVPQPNGRWGSQIYEKHQRVWLGTFNEEDEAARAYDVAVQRFRGKDAVTNFKPLSGTDDDDGESEFLNSHSKSEIVDMLRKHTYNDELEQSKRSRGFVRRRGSAAGAGNGNSISGACVMKAREQLFQKAVTPSDVGKLNRLVIPKQHAEKHFPLQSAANGVSATAAAAKGVLLNFEDVGGKVWRFRYSYWNSSQSYVLTKGWSRFVKEKNLKAGDTVCFQRSTGPDRQLYIDWKTRNVVNEVALFGPVVEPIQMVRLFGVNILKLPGSDSIANNNNASGCCNGKRREMELFSLECSKKPKIIGAL

SEQ ID NO: 439 - protein, 386 aa, Capsicum annuum
  misc_feature (1)..(386): Public GI No. 33320073
  misc_feature (1)..(386): Functional Homolog of  Ceres CLONE ID no. 38311 at SEQ ID NO. 436 with e-value of 3.70E-101 and percent identity of 68.6
MEGTSSIDQESTTSDSLSIAPMTTTKPPESLCRMGSGTSSVIIDGENGVEAESRKLPSSKYKGVVPQPNGRWGAQIYEKHQRVWLGTFNEENEAARAYDVAAQRFRGRDAVTNFKPLLENQESDDDVEIAFLNSHSKAEIVDMLRKHTYIDELEQSKKLFGYTKDGTMAKNKDGLIDISSFFGGGGTIDKVNNKVREQLFEKAVTPSDVGKLNRLVIPKQHAEKHFPLQNGNNSKGVLLNFEDLNGKVWRFRYSYWNSSQSYVLTKGWSRFVKEKNLKAGDIVSFQRSTSGDKQLYIDFKARNMAPTNPVVTNQVQAQVQVPRVQMMRLFGVNICKIPATINNVVDNNNNNNNNMANCSGGKRMMEMELLTFESCRKKQRVIIDAL

SEQ ID NO: 440 - protein, 392 aa, Triticum aestivum
  misc_feature (1)..(392): Ceres CLONE ID no. 705041
  misc_feature (1)..(392): Functional Homolog of  Ceres CLONE ID no. 38311 at SEQ ID NO. 436 with e-value of 4.39E-82 and percent identity of 62.0
MDSARSCLVDDVSSGASTGKKASPSPAAPATKPLQRVGSGASAVMDAPEPGAEADSGRVGRLPSSKYKGVVPQPNGRWGAQIYERHQRVWLGTFTGEAEAARAYDAAAQRFRGRDAVTNFRSLTESDPEDAAELRFLAARSKAEVVDMLRKHTYPDELAQYKRAYFAAAAASSPTSSSVPPASSPSSAASPSPAARREHLFDKTVTPSDVGKLNRLVIPKQHAEKHFPLQLPSAGAAVSGECKGMLLNFDDSAGKVWRFRYSYWNSSQSYVLTKGWSRFVKEKGLHAGDAVGFYRSASGSNQLFIDCKLRSKTTTMTTTFVNAAAAPSPAPVMRTVRLFGVDLLTAPAPSHVPEHEDCSMVPKTSKRSMDANAAATPAHAVWKKRCIDFALT

SEQ ID NO: 441 - protein, 395 aa, Zea mays
  misc_feature (1)..(395): Ceres CLONE ID no. 331400
  misc_feature (1)..(395): Functional Homolog of  Ceres CLONE ID no. 38311 at SEQ ID NO. 436 with e-value of 6.40E-81 and percent identity of 62.4
MDSASSLVDDTSSGGGGGGGASTDKLRALAVFAAASGTPLERMGSGASAVVDAAEPGAEADSGSGAAAVSVGGKLPSSRYKGVVPQPNGRWGAQIYERHQRVWLGTFAGEADAARAYDVAAQRFRGRDAVTNFRPLADADPDAAAELRFLASRSKAEVVDMLRKHTYFDELAQNKRAFAAASAATASSLANNPSSYASLSPATATAAAAAAREHLFDKTVTPSDVGKLNRLVIPKQHAEKHFPLQLPSAGGESKGVLLNLEDAAGKVWRFRYSYWNSSQSYVLTKGWSRFVKEKGLQAGDVVGFYRSAAGADTKLFIDCKLRPNSVVAASTAGPSPRAPVAKAVRLFGVDLLTAPATAAAAPAEAVAVAGCKRARDLGSPPQAAFKKQLVELALV

SEQ ID NO: 442 - protein, 394 aa, Oryza sativa subsp. japonica
  misc_feature (1)..(394): Public GI No. 50932645
  misc_feature (1)..(394): Functional Homolog of  Ceres CLONE ID no. 38311 at SEQ ID NO. 436 with e-value of 2.20E-80 and percent identity of 63.4
MDSTSCLLDDASSGASTGKKAAAAAASKALQRVGSGASAVMDAAEPGAEADSGGERRGGGGGKLPSSKYKGVVPQPNGRWGAQIYERHQRVWLGTFTGEAEAARAYDVAAQRFRGRDAVTNFRPLAESDPEAAVELRFLASRSKAEVVDMLRKHTYLEELTQNKRAFAAISPPPPKHPASSPTSSSAAREHLFDKTVTPSDVGKLNRLVIPKQHAEKHFPLQLPPPTTTSSVAAAADAAAGGGDCKGVLLNFEDAAGKVWKFRYSYWNSSQSYVLTKGWSRFVKEKGLHAGDAVGFYRAAGKNAQLFIDCKVRAKPTTAAAAAAFLSAVAAAAAPPPAVKAIRLFGVDLLTAAAPELQDAGGAAMTKSKRAMDAMAESQAHVVFKKQCIELALT

SEQ ID NO: 443 - DNA, 1478 bp, Zea mays
  misc_feature (1)..(1478): Ceres CLONE ID no. 386908
  misc_feature (1)..(1478): Also Known As Ceres GEMINI ID no. 539G10
atagcatattagcatatggtattggagatgggcccccggacccgaaatccccgccgcacttaagtactacaatcccaggggccaggccaccggcatgttcgcttccatctgccggcggcggctcttccgcctctgtcaaatccccttcggcaccggcgcaatccctagcgacgccctcccccactgccactccttagcaaccatcgcggacgctcccgtctccgagccctgtgctgcccttgtctcttgcgggctctcccccgccgccgcggtcgcccacaagctcccaatccgctccaccgccaaggccgacgccgtccgtgcgctcctccgcagctacggcttcaccgacgcggaggtcgccgacctagtccgccgattatcgcagatcctcagcgtcgaccccgaccggatccgccccaagcttgacctcttcgcctccctcggcgtcaagccgcggcggctcgccagatatcctgccctcctcacgcgcagcctcgacaagcacctcgtcccctgcatccagttcctccgcaacattctcagcaccgatgaggacgtctgcctcgccatctcgcgcaccccgcgcgccctctcggctggcctggagaagatcatgcggcccgccgtggacaccctccgccgtcttgggctccccgatgagtctatctcgaagttagtagtcatcgagatgggcgtgctcatgatgtcgcccgaccgcatatgccagatcttcgaggccctcaaggagttcggcttgggcgtaacggagaagcgctttccttacggcatccgcgccttgtgctgcattagtagggagaagtggctgcatagggtggccctttaccggagcttcggggtgtccgagggtgagctgcagagagcgttcaagaaacagccgaatatagttaacttctctgatgagatcataaagaagaagatccggttcttcctggatgtgctgaagcttgaactaagcgaagtaatggagcaacctgcgattatagggtatagcttggagaggaacatcataccaaggtgtgccgtgctaagcttgttgatgagggagggaaagattgggcccaacgtcaagttgatttcggcattgcttggtagtgccaacatgttctccacaaggtatgtattgaggtatgccaatgagttgccagatgttgttaaggcatatgagggtaagatcacatttgatgtcttcagggaacaggatcttttagttccactgaagctgtgagacaagtttagcaagattatgtcacaagtttaggcgccatgctttccaatgccattgagatcatagcatgctatgattctaacactgttttattgttatgttaattctggacatttttcacataaccatctttgtagcatttccctttttttatcctcgctaacaaatgtaaaaatacggatcttgtgatgctgtcttagttatttgatctggtgagctgaactggttc

SEQ ID NO: 444 - protein, 384 aa, Zea mays
  misc_feature (1)..(384): Ceres CLONE ID no. 386908
  misc_feature (1)..(384): Also Known As Ceres GEMINI ID no. 539G10
  misc_feature (75)..(146): Pfam Name: mTERF Pfam Description: mTERF
MFASICRRRLFRLCQIPFGTGAIPSDALPHCHSLATIADAPVSEPCAALVSCGLSPAAAVAHKLPIRSTAKADAVRALLRSYGFTDAEVADLVRRLSQILSVDPDRIRPKLDLFASLGVKPRRLARYPALLTRSLDKHLVPCIQFLRNILSTDEDVCLAISRTPRALSAGLEKIMRPAVDTLRRLGLPDESISKLVVIEMGVLMMSPDRICQIFEALKEFGLGVTEKRFPYGIRALCCISREKWLHRVALYRSFGVSEGELQRAFKKQPNIVNFSDEIIKKKIRFFLDVLKLELSEVMEQPAIIGYSLERNIIPRCAVLSLLMREGKIGPNVKLISALLGSANMFSTRYVLRYANELPDVVKAYEGKITFDVFREQDLLVPLKL

SEQ ID NO: 445 - DNA, 1198 bp, Arabidopsis thaliana
  misc_feature (1)..(1198): Ceres CLONE ID no. 38950
  misc_feature (1)..(1198): Also Known As Ceres CDNA ID no. 23377175
  misc_feature (1)..(1198): Also Known As Ceres GEMINI ID no. 554E4
attttagtaatcaaagtccaattagtgaaaaggggttttcttgtgagaagagaaagagaagctatgagtgacgcgttttgttcggactgtaagaggcacacggaggttgtgtttgaccattccgccggagatacagtttgttcagagtgtggtctcgtgcttgaatctcactcaatcgatgaaacttctgagtggcgtactttcgctaatgagtccggtgataatgatcctgttcgtgtcggtggtccgacgaatcctcttttagcagatggtggtctcactactgtcatttctaaacctaatggatcctctggcgatttcctctcttcttctcttggtcgatggcagaatcgtggatctaatcctgatcgtggccttattgttgctttcaagactatcgctaccatggctgataggttgggacttgttgcgaccatcaaggaccgagcgaatgagatttataaaagggtagaggatcagaagtcaagtagaggaagaaatcaggatgctcttttggctgcttgtttatacattgcttgccggcaagaagacaaaccacggacggtcaaggaaatatgctctgttgccaatggagctactaagaaggagattggtcgtgcaaaagagtacatagtcaaacagttggggctggaaaccggacaattggttgaaatgggtactatacatgctggagattttatgagacgtttttgctccaatcttggtatgaccaaccaaaccgtgaaagcggctcaagagtctgtgcaaaagtcagaggaatttgatataaggaggagtcccatatcgattgcagcagcggttatatacatcataacacagctctctgatgagaagaagcctcttcgagatatatcagtggcaactggagtcgcggaaggaactataagaaactcttacaaagatctttaccctcacctttccaagatcataccagcttggtacgctaaagaagaagatctcaagaaccttcaaagcccttgagtgtcttcctcttctaatctcttactcgcaaccataccttcaagtttcgattgggattatgggttataaagttgttttgtccagaagtgcgactggaggcacgcttgaacaagagttttacagtagatttgtatcactttttcttcataaggtaccatacattgttgaattaatgagatggtatttctagttgatc

SEQ ID NO: 446 - protein, 312 aa, Arabidopsis thaliana
  misc_feature (1)..(312): Ceres CLONE ID no. 38950
  misc_feature (1)..(312): Also Known As Ceres CDNA ID no. 23377175
  misc_feature (1)..(312): Also Known As Ceres GEMINI ID no. 554E4
  misc_feature (112)..(183): Pfam Name: TFIIB Pfam Description: Transcription factor TFIIB repeat
MSDAFCSDCKRHTEVVFDHSAGDTVCSECGLVLESHSIDETSEWRTFANESGDNDPVRVGGPTNPLLADGGLTTVISKPNGSSGDFLSSSLGRWQNRGSNPDRGLIVAFKTIATMADRLGLVATIKDRANEIYKRVEDQKSSRGRNQDALLAACLYIACRQEDKPRTVKEICSVANGATKKEIGRAKEYIVKQLGLETGQLVEMGTIHAGDFMRRFCSNLGMTNQTVKAAQESVQKSEEFDIRRSPISIAAAVIYIITQLSDEKKPLRDISVATGVAEGTIRNSYKDLYPHLSKIIPAWYAKEEDLKNLQSP

SEQ ID NO: 447 - protein, 312 aa, Arabidopsis thaliana
  misc_feature (1)..(312): Ceres CLONE ID no. 2657
  misc_feature (1)..(312): Functional Homolog of  Ceres CLONE ID no. 38950 at SEQ ID NO. 446 with e-value of 0.0 and percent identity of 85.9
MSDAYCTDCKKETELVVDHSAGDTLCSECGLVLESHSIDETSEWRTFANESSNSDPNRVGGPTNPLLADSALTTVIAKPNGSSGDFLSSSLGRWQNRNSNSDRGLIQAFKTIATMSERLGLVATIKDRANELYKRLEDQKSSRGRNQDALYAACLYIACRQEDKPRTIKEICVIANGATKKEIGRAKDYIVKTLGLEPGQSVDLGTIHAGDFMRRFCSNLAMSNHAVKAAQEAVQKSEEFDIRRSPISIAAVVIYIITQLSDDKKTLKDISHATGVAEGTIRNSYKDLYPHLSKIAPSWYAKEEDLKNLSSP

SEQ ID NO: 448 - protein, 312 aa, Oryza sativa
  misc_feature (1)..(312): Public GI No. 18481632
  misc_feature (1)..(312): Functional Homolog of  Ceres CLONE ID no. 38950 at SEQ ID NO. 446 with e-value of 0.0 and percent identity of 84.6
MSDSFCPDCKKHTEVAFDHSAGDTVCTECGLVLEAHSVDETSEWRTFANESSDNDPVRVGGPTNPLLTDGGLSTVIAKPNGAQGEFLSSSLGRWQNRGSNPDRSLILAFRTIANMADRLGLVATIKDRANEIYKKVEDLKSIRGRNQDAILAACLYIACRQEDRPRTVKEICSVANGATKKEIGRAKEFIVKQLEVEMGQSMEMGTIHAGDFLRRFCSTLGMNNQAVKAAQEAVQRSEELDIRRSPISIAAAVIYMITQLSDDKKPLKDISLATGVAEGTIRNSYKDLYPYASRLIPNTYAKEEDLKNLCTP

SEQ ID NO: 449 - protein, 315 aa, Triticum aestivum
  misc_feature (1)..(315): Ceres CLONE ID no. 749427
  misc_feature (1)..(315): Functional Homolog of  Ceres CLONE ID no. 38950 at SEQ ID NO. 446 with e-value of 1.09E-70 and percent identity of 53.1
MPTGADERVYCPDCRRATEVVLDHGTGDTICTECALVLDAHYIDEGFEWRNFADDGGGEDRDPSRVGASGDPFLNAKLSTVIAYDKKPGKSSGEAGALPRTSVSGDGAGAASDKTLVDGFRGIGDMADRLGLVATIRDHAKETFKKLDEAKGVPRGRNRDSVYAACLYIACRNLGMPRTYKELASVTAAGPAAKKDIGKMSTHIKKLLGEEDGQVMDIGVVSASDYLRRFCSRLGLGNQEVRDAQEAVRRLEERLDVRRNPESIAAAVIYMVVQRAGATNPNSAVKDVSVATGVAEGTIKEAHKDLTPHAQMLFA

SEQ ID NO: 450 - DNA, 1639 bp, Zea mays
  misc_feature (1)..(1639): Ceres CLONE ID no. 389585
  misc_feature (1)..(1639): Also Known As Ceres CDNA ID no. 23810539
  misc_feature (1)..(1639): Also Known As Ceres GEMINI ID no. 539A11
gcacgagaccattacctagaacatcctaatcgaaaaatttttcggattgggatcatcagcggctgtagcgtggacccgacgggggtgcccggaccacatccctatttcatcttggtaccccgtccgtctccgattttagaagcacggcgggctccccggcagcctcaaccgagcagaaagctgagttctaccccagaaccgaggcatggaggacgaagaaaacatcgagggagaactgttgctcgtggagtcacaactccacgacatccaaggacaaattaaaacattactcgatcgccaagaggagttgtatgaacgccaggcacagttgaaggctttgctcgaagcatctaaattgaccagaaatacaacaattaacacatcttcagttgctccggaagattggtctgggagcttcccatgggatctggaggctgacgataccaggttcaatatatttggcatttcctcctaccgatcaaatcaacgagaaataattaatgcagtcatgagtggaagagatgttctggtcataatggcagctggtggagggaagagtctatgttaccagctcccagctgtacttcgtgatggaattgcactggttgtcagtcctttactttcccttattcaggaccaggtcataggactgtcagctttaggtataccagcatacatgctaacttcaactaccaacaaggaagttgagaagttcatctataagacacttgataaaggagaaggagaactaaagatattatatgtgacacctgaaaagatctcaaaaagtaaaaggttcatgtctaagctcgagaaatgccatcatgccggtcgtctttctctgattgcaatagatgaggctcactgctgtagccaatggggtcatgattttcgtcctgactacaagaatcttggcattttgaaaattcaatttcccagtgttccaatgatagctttaactgcaactgcaacaagtaaggtccaaatggatttaatggagatgctccacatcccgagatgcatcaagtttgtcagcacagttaacaggcccaaccttttttataaggtgtctgagaaatcgccagttggaaaggttgtcattgatgagatcacaaagtttataagtgaatcatacccaaataatgagtctggaattatatactgcttttcaaggaaggaatgtgaacaggttgcaaaagaactgcgcgaaaggggtatttcagcagattattatcatgcagacatggatatcgttaatcgtgagaaaattcatatgcggatcgacacacaagggatgtgattgggactggccgtcgccgtaaatcttcgcctcgcctctacatcttggacaccttgcgtcttccttcacaccatatcactacaactcatgtgcttgctgcttcaggtcccacgacgtcgttcgcccagtggcatcattgtcttggtcacttatgtggatctcgtctgtctactctaataaagtcaggatgtttaggtcctacacatgttgagtctagttttcattgtaaaggttgtcatcttggcaaacaaatacaacctccatattttacccgtttgtttctaaaggtggtcataaatattatgtcattttattgatgattattctcgttatacttgg

SEQ ID NO: 451 - protein, 364 aa, Zea mays
  misc_feature (1)..(364): Ceres CLONE ID no. 389585
  misc_feature (1)..(364): Also Known As Ceres CDNA ID no. 23810539
  misc_feature (1)..(364): Also Known As Ceres GEMINI ID no. 539A11
  misc_feature (90)..(263): Pfam Name: DEAD Pfam Description: DEAD/DEAH box helicase
MEDEENIEGELLLVESQLHDIQGQIKTLLDRQEELYERQAQLKALLEASKLTRNTTINTSSVAPEDWSGSFPWDLEADDTRFNIFGISSYRSNQREIINAVMSGRDVLVIMAAGGGKSLCYQLPAVLRDGIALVVSPLLSLIQDQVIGLSALGIPAYMLTSTTNKEVEKFIYKTLDKGEGELKILYVTPEKISKSKRFMSKLEKCHHAGRLSLIAIDEAHCCSQWGHDFRPDYKNLGILKIQFPSVPMIALTATATSKVQMDLMEMLHIPRCIKFVSTVNRPNLFYKVSEKSPVGKVVIDEITKFISESYPNNESGIIYCFSRKECEQVAKELRERGISADYYHADMDIVNREKIHMRIDTQGM

SEQ ID NO: 452 - DNA, 934 bp, Arabidopsis thaliana
  misc_feature (1)..(934): Ceres CLONE ID no. 39279
  misc_feature (1)..(934): Also Known As Ceres CDNA ID no. 23362522
  misc_feature (1)..(934): Also Known As Ceres GEMINI ID no. 535C7
aaaaggcgttacagagaagaagaagaagaagaagaagaaggagaaatgtcagacgacgacgagagaggcgaagagtacctcttcaagattgttatcatcggtgattccgccgtcggcaaatccaatctcctcactcgctacgcctgtaacgagttcaatcccaattccaaagccactatcggcgtcgagtttcagactcagagcatgctcatcgacggcaaagaggtcaaagctcagatttgggataccgccggtcaggaacgcttccgcgccgttacatctgcttattaccgtggcgccgttggagccctcgtcgtctacgatatcactcgtagctccactttcgaaaacgtcggtcgctggctcgatgagctcaacactcattctgatacaacagtagcaaaaatgcttattgggaacaaatgtgatctcgagagcataagagcggtgagtgttgaggaaggcaagagtcttgctgagtctgaaggtttgtttttcatggagacctctgcgttggactcgaccaatgtaaagacggctttcgagatggttattcgggagatctatagcaacattagtcgaaagcaattgaactctgattcttacaaagaggagctgactctgaatcgtgttagcttggttaagaacgagaacgaagggacaaagacattctcttgctgttcgaggtaacatctttgtaacggtttctctttgtcctgaggattggtttcgggttgaattgtgttcctggtaaacttatagaaaggcagagatatattcttatagttctcagttaaagtaaaagaagaagagagaaagatgttttgagtttctttgttacgcatacagaaaaagtttggttagtgtataagttatgttctcatttgtaacttttgtaaacttatgattgttaaatcaattttgatattttccg

SEQ ID NO: 453 - protein, 214 aa, Arabidopsis thaliana
  misc_feature (1)..(214): Ceres CLONE ID no. 39279
  misc_feature (1)..(214): Also Known As Ceres CDNA ID no. 23362522
  misc_feature (1)..(214): Also Known As Ceres GEMINI ID no. 535C7
  misc_feature (4)..(173): Pfam Name: Arf Pfam Description: ADP-ribosylation factor family
MSDDDERGEEYLFKIVIIGDSAVGKSNLLTRYACNEFNPNSKATIGVEFQTQSMLIDGKEVKAQIWDTAGQERFRAVTSAYYRGAVGALVVYDITRSSTFENVGRWLDELNTHSDTTVAKMLIGNKCDLESIRAVSVEEGKSLAESEGLFFMETSALDSTNVKTAFEMVIREIYSNISRKQLNSDSYKEELTLNRVSLVKNENEGTKTFSCCSR

SEQ ID NO: 454 - protein, 219 aa, Arabidopsis thaliana
  misc_feature (1)..(219): Public GI No. 32815939
  misc_feature (1)..(219): Functional Homolog of  Ceres CLONE ID no. 39279 at SEQ ID NO. 453 with e-value of 4.89E-91 and percent identity of 85.9
MSSDDEGGEEYLFKIVIIGDSAVGKSNLLSRYARNEFNAHSKATIGVEFQTQNMEIEGKEVKAQIWDTAGQERFRAVTSAYYRGAVGALVVYDISRRSTFESVGRWLDELKTHSDTTVARMLVGNKCDLESIRAVSVEEGKALAETEGLFFMETSALDSTNVKTAFEMVIRDIYTNISRKQLNSDTYKTELSMKNRVSLVKDDNKSSTQGFGFSCCSSS

SEQ ID NO: 455 - protein, 218 aa, Arabidopsis thaliana
  misc_feature (1)..(218): Public GI No. 17380746
  misc_feature (1)..(218): Functional Homolog of  Ceres CLONE ID no. 39279 at SEQ ID NO. 453 with e-value of 5.60E-90 and percent identity of 83.5
MSSDDEGREEYLFKIVVIGDSAVGKSNLLSRYARNEFSANSKATIGVEFQTQSMEIEGKEVKAQIWDTAGQERFRAVTSAYYRGAVGALVVYDITRRTTFESVGRWLDQLKIHSDTTVARMLVGNKCDLENIRAVSVEEGKALAEEEGLFFVETSALDSTNVKTAFEMVILDIYNNVSRKQLNSDTYKDELTVNRVSLVKDDNSASKQSSGFSCCSST

SEQ ID NO: 456 - protein, 219 aa, Arabidopsis thaliana
  misc_feature (1)..(219): Ceres CLONE ID no. 15416
  misc_feature (1)..(219): Functional Homolog of  Ceres CLONE ID no. 39279 at SEQ ID NO. 453 with e-value of 4.00E-89 and percent identity of 84.5
MSSDDEGGEEYLFKIVIIGDSAVGKSNLLSRYARNEFNAHSKATIGVELETQNMEIEGKEVKAQIWDTACQERFRAVTSAYYRGAVGALVVYDISRRSTFESVGRWLDELKTHSDTTVARMLVGNKCDLESIRAVSVEEGKALAETEGLFFMETSALDSTNVKTAFEMVIRDIYTNISRKQLNSDTYKTELSMKNRVSLVKDDNKSSTQGFGFSCCSSS

SEQ ID NO: 457 - protein, 219 aa, Brassica napus
  misc_feature (1)..(219): Public GI No. 1076457
  misc_feature (1)..(219): Functional Homolog of  Ceres CLONE ID no. 39279 at SEQ ID NO. 453 with e-value of 1.20E-87 and percent identity of 82.6
MSSDEEGGEEYLFKIVIIGDSAVGKSNLLSRYARNEFNAHSKATIGVEFQTQSMEIEGKDVKAQIWDTAGQERFRAVTSAYYRGAVGALVVYDISRRSTFESVARWLDELKTHSDTTVARMLVGNKCDLDNMRAVSVEEGKALAETQGLFFMETSALNSTNVKTAFEMVIRDIYANFSRKQLNSDMHKTELKWNSRVSLVKDDNKGSKQGSGFSCCSSS

SEQ ID NO: 458 - protein, 219 aa, Glycine max
  misc_feature (1)..(219): Public GI No. 499068
  misc_feature (1)..(219): Functional Homolog of  Ceres CLONE ID no. 39279 at SEQ ID NO. 453 with e-value of 2.60E-85 and percent identity of 81.0
MSGSEDEGGEEYLFKIVIIGDSAVGKSNLLSRYARNEFNMHSKATIGVEFQTQCLEIDSKEVKAQIWDTAGQERFRAVTSAYYRGAVGALIVYDISRRTTFDSVGRWLDELKTHCDTTVAMMLVGNKCDLENIRAVSIDEGKSLAEAEGLFFMETSALDSTNVKMAFEMVIREIYNNVSRKVLNSETYKAELSVNRVSLVNNGAATSKQNQTYFSCCSR

SEQ ID NO: 459 - protein, 219 aa, Glycine max
  misc_feature (1)..(219): Public GI No. 2118462
  misc_feature (1)..(219): Functional Homolog of  Ceres CLONE ID no. 39279 at SEQ ID NO. 453 with e-value of 4.30E-83 and percent identity of 79.6
MSGSEDEGGEEYLFKIVIIGDSAVGKSNLLSRYARNEFNMHSKATIGVEFQTQCLEIDSKEVKAQIWDTAGQERFRAVTSAYYRGAVGALIVYDISRRTTFDSVGRWLDELKTHCDTTVAMMLVGNKCDLENIRAVSIDEGKSLAEAEGLQFMETSALDSTNVKMAQEMVIREIYNNVSRKVLNSETYKAELSVNRVSLVNNGAATSKQNQTYQSCCSR

SEQ ID NO: 460 - protein, 217 aa, Triticum aestivum
  misc_feature (1)..(217): Ceres CLONE ID no. 789317
  misc_feature (1)..(217): Functional Homolog of  Ceres CLONE ID no. 39279 at SEQ ID NO. 453 with e-value of 2.29E-84 and percent identity of 80.6
MGDDSDGEAEEYLFKVVIIGDSAVGKSNLLSRYARNEFNLHSKATIGVEFQTQSMDIDGKEVKAQIWDTAGQERFRAVTSAYYRGAFGALLVYDISRRGTFDNVGRWLQELNTHSDTTVAKMLVGNKCDLENIREVPVEEGKALAESEGLFFMETSALDSTNVNTAFELVIKEIYSSVSRKILNSDTYKAELSLNRVSIDDGDSKDSQKQTSRFGCC

SEQ ID NO: 461 - protein, 216 aa, Zea mays
  misc_feature (1)..(216): Ceres CLONE ID no. 483433
  misc_feature (1)..(216): Functional Homolog of  Ceres CLONE ID no. 39279 at SEQ ID NO. 453 with e-value of 1.19E-85 and percent identity of 81.1
MGDEPDGEAEEYLFKVVIIGDSAVGKSNLLSRYARNEFNPHSKATIGVEFQTQSMAIEGKEVKAQIWDTAGQERFRAVTSAYYRGAFGALLVYDITRRSTFDNVGRWLQELNTHSDTTVAKMLVGNKCDLGDIRQVPVEEGKALAEAEGLFFMETSALDATNVRTAFEIVIREIYSNVSRKVLNSDSYKAELSLNRVSIDGDSKDEQKQGSRFGCC

SEQ ID NO: 462 - protein, 219 aa, Lotus japonicus
  misc_feature (1)..(219): Public GI No. 1370154
  misc_feature (1)..(219): Functional Homolog of  Ceres CLONE ID no. 39279 at SEQ ID NO. 453 with e-value of 7.59E-86 and percent identity of 81.1
MSSSEDEGGEEYLFKIVIIGDSAVGKSNLLSRYARNEFNMHSKATIGVEFQTQSLEIDSKEVKAQIWDTAGQERFRAVTSAYYRGAVGALIVYDITRRTTFDSVSRWLDELKTHCDTTVAMMLVGNKCDLENIRAVSIEEGKSLAEAQGLFFMETSALDSTNVRTAFEMVIREIYNNVSRKVLNSDTYKAELSVDRVSLVNNGAATSKQSKSYFSCCST

SEQ ID NO: 463 - protein, 216 aa, Oryza sativa subsp. japonica
  misc_feature (1)..(216): Public GI No. 50947781
  misc_feature (1)..(216): Functional Homolog of  Ceres CLONE ID no. 39279 at SEQ ID NO. 453 with e-value of 9.99E-84 and percent identity of 79.2
MGDESEGETEEYLFKVVIIGDSAVGKSNLLSRYARNEFNLHSKATIGVEFQTQSMDINGKDVKAQIWDTAGQERFRAVTSAYYRGAFGALLVYDISRRSTFDNVGRWLQELNTHSDTTVAKMLVGNKCDLDNIREVPVEEGKALAEAEGLFFMETSALDSTNVRTAFEIVIKEIYSNVSRKILNSDSYKAELSLNRVSIEGDSKDDQKQSNRFGCC

SEQ ID NO: 464 - DNA, 1269 bp, Zea mays
  misc_feature (1)..(1269): Ceres CLONE ID no. 393033
  misc_feature (1)..(1269): Also Known As Ceres GEMINI ID no. 539C11
aaaacaacaaaaaaacccagcctagcagctgctagctattgctactacctcccttctccatccgctccaagttgccatgcgcgctggctacggatgatgactactacaacaagtcgatcccagcagtagaagctagctagcatcgagatctgctggctccggcatatcatcgatccccggccggcccgctgtagagcaagcaaatggccaagtactactggggtatgctgggcgccgcaaccaccacgacccgcgctggtactggtagcagcctcatcaggtccacctggccacctccggcagcgcatggcggcggccgcagcggcgagccgtcgtgggaggagctggccttcgcccaggacgcggcggggcaactcggcggctgcgtctggccgccgcgctcctacacgtgcaccttctgccgccgagagttccggtccgcgcaggcgctgggcggccatatgaacgtgcaccgccgcgaccgggctcgcctccggcagtgcgccccgccggatcatgaccaggagccgatcgccgcgcctcttccagcgccggaattggcggatcaccagcagcagcttctgcaactgcatggatctcccatgaccaaggcggcagtattattctctggccgccctgctgctgcttgctgtactcatcagcaaacttattgcaataacaacagggagggggagggggaggattctcctgctcggtacatatcaacgacgacgaccatcatcaaggagagcaagagcaaggtactcatctccatacctgcagcaacgacagcagcggggagcaaaaaagccgctactactatagcaatcatcggtgaggaggaggaggaggaagaagaagaggaagagatcatggtgacggggcggaggacgaaacgaaggcggctagtccatcagccgttctacgacctgcggcggcttccgccggcatcatcatcacccaataaaggaggagttgaagatgatgatgcaaaggtacccaaattaagcagccctataagcctcagtcatcatcttgcaggccggcaagaagaagtggatctggagctcaggcttggcactagctgctagctagtcgcgatcggccgtccgatccctaaattaagttgcgtgaatggatccatatatctctcttttcacttcaccataactaagatcgagtgtgtgcgtgcacaactgaatcatatatatcatctgctgctgcttgcttcattcatatatcatatatatatagtatgctcctcgtgat

SEQ ID NO: 465 - protein, 295 aa, Zea mays
  misc_feature (1)..(295): Ceres CLONE ID no. 393033
  misc_feature (1)..(295): Also Known As Ceres GEMINI ID no. 539C11
MAKYYWGMLGAATTTTRAGTGSSLIRSTWPPPAAHGGGRSGEPSWEELAFAQDAAGQLGGCVWPPRSYTCTFCRREFRSAQALGGHMNVHRRDRARLRQCAPPDHDQEPIAAPLPAPELADHQQQLLQLHGSPMTKAAVLFSGRPAAACCTHQQTYCNNNREGEGEDSPARYISTTTTIIKESKSKVLISIPAATTAAGSKKAATTIAIIGEEEEEEEEEEEIMVTGRRTKRRRLVHQPFYDLRRLPPASSSPNKGGVEDDDAKVPKLSSPISLSHHLAGRQEEVDLELRLGTSC

SEQ ID NO: 466 - DNA, 1577 bp, Arabidopsis thaliana
  misc_feature (1)..(1577): Ceres CLONE ID no. 3997
  misc_feature (1)..(1577): Also Known As Ceres CDNA ID no. 24418108
  misc_feature (1)..(1577): Also Known As Ceres GEMINI ID no. 533D10
ctacctcaatttatattatttgcttcaatcttctctttatcgctccaccagatccaagttcgcgagatttcaagctctctaacaaagttcttcacttttgctctcaaagctttcatctttcattcaactacttaagctccaagtatggcaggatccgcaccggaaggaacacaatttgatacgcgtcagtttgaccagaggctgaatgaagttctcgatggacaggatgagttcttcacctcatatgatgaggtccatgagagctttgatgccatgggtttgcaagagaatcttcttaggggtatctatgcttacggtttcgaaaagccttctgctattcagcaaagaggaattgtacccttttgcaagggtcttgatgtgatccagcaggcacagtctggtactggaaaaaccgccactttctgctctggtgtcttgcagcagcttgactatgcccttctccagtgccaggctctcgttttggctcccaccagagagcttgctcagcagattgagaaggtcatgcgtgcccttggtgactaccaaggtgtcaaggttcatgcctgtgttggtggaaccagtgtccgtgaggatcagcgcattctccaggctggtgttcatgttgtcgttggaactcccggtcgtgtttttgacatgcttagaagacaatctctccgccctgactgcatcaagatgtttgtccttgatgaagctgatgaaatgctctcccgtggtttcaaggatcagatctatgacatattccagcttctcccaccaaagattcaggttggagtgttctctgcgacaatgcctccggaagctttggagatcacaagaaaattcatgagcaaaccagtgagaatcttggtgaaacgtgatgagctcacacttgaaggtatcaagcaattctacgtgaacgtggagaaagaagactggaagcttgagactctctgcgatctctacgagactctagccatcactcagagtgtcatctttgtcaacactcgtcgcaaggtcgactggctcacagacaaaatgagaagccgtgaccacacagtctcagcaactcatggagacatggaccaaaacaccagagacatcatcatgagagagttcaggtctggctcgtctcgtgttctaatcacaaccgatctcttggctcgtggtatcgatgtgcagcaagtctctctagtcataaactttgacctcccaactcagccagagaattaccttcaccgtatcggaagaagtggaaggttcgggagaaagggtgtggcgattaactttgtgactcttgatgatcagagaatgctgtttgatattcagaaattctacaatgtggttgttgaggagcttccctcaaacgtggctgatttgctgtgaagaagaagaagaagaagaagaagaaaggttgcttgtttcgcaaatttcttatttgatttttgacccgtctctctctctctgaatcatcgatacatctttttcattctctagtattcttcatcaactctatcgaacatatatatgtctcttctgaccatatttcttttttatcaaatgcaatatttatttcttct

SEQ ID NO: 467 - protein, 412 aa, Arabidopsis thaliana; identical to SEQ ID NO: 313
  misc_feature (1)..(412): Ceres CLONE ID no. 3997
  misc_feature (1)..(412): Also Known As Ceres CDNA ID no. 24418108
  misc_feature (1)..(412): Also Known As Ceres GEMINI ID no. 533D10
  misc_feature (297)..(373): Pfam Name: Helicase_C Pfam Description: Helicase conserved C-terminal domain
  misc_feature (62)..(229): Pfam Name: DEAD Pfam Description: DEAD/DEAH box helicase

SEQ ID NO: 468 - protein, 412 aa, Arabidopsis thaliana
  misc_feature (1)..(412): Ceres CLONE ID no. 30700
  misc_feature (1)..(412): Functional Homolog of  Ceres CLONE ID no. 3997 at SEQ ID NO. 467 with e-value of 0.0 and percent identity of 96.6
MAGSAPEGTQFDARQFDQKLNEVLEGQDEFFTSYDDVHESFDAMGLQENLLRGIYAYGFEKPSAIQQRGIVPFCKGLDVIQQAQSGTGKTATFCSGVLQQLDFSLIQCQALVLAPTRELAQQIEKVMRALGDYLGVKVHACVGGTSVREDQRILQAGVHVVVGTPGRVFDMLKRQSLRADNIKMFVLDEADEMLSRGFKDQIYDIFQLLPPKIQVGVFSATMPPEALEITRKFMSKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTRDDERMLFDIQKFYNVVVEELPSNVADLL

SEQ ID NO: 469 - protein, 412 aa, Arabidopsis thaliana
  misc_feature (1)..(412): Public GI No. 19698881
  misc_feature (1)..(412): Functional Homolog of  Ceres CLONE ID no. 3997 at SEQ ID NO. 467 with e-value of 0.0 and percent identity of 96.3
MAGSAPEGTQFDARQFDQKLNEVLEGQDEFFTSYDDVHESFDAMGLQENLLRGIYAYGFEKPSAIQQRGIVPFCKGLDVIQQAQSGTGKTATFCSGVLQQLDFSLIQCQALVLAPTRELAQQIEKVMRALGDYLGVKVHACVGGTSVREDQRILQAGVHVVVGTPGRVFDMLKRQSLRADNIKMFVLDEADEMLSRGFKDQIYDIFQLLPPKIQVGVFSATMPPEALEITRKFMSKPVRILVKRDELTVEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTRDDERMLFDIQKFYNVVVEELPSNVADLL

SEQ ID NO: 470 - protein, 413 aa, Nicotiana plumbaginifolia; identical to SEQ ID NO: 314
  misc_feature (1)..(413): Public GI No. 19697
  misc_feature (1)..(413): Functional Homolog of  Ceres CLONE ID no. 3997 at SEQ ID NO. 467 with e-value of 0.0 and percent identity of 93.4

SEQ ID NO: 471 - protein, 413 aa, Nicotiana tabacum; identical to SEQ ID NO: 315
  misc_feature (1)..(413): Public GI No. 2119938
  misc_feature (1)..(413): Functional Homolog of  Ceres CLONE ID no. 3997 at SEQ ID NO. 467 with e-value of 0.0 and percent identity of 93.2

SEQ ID NO: 472 - protein, 413 aa, Nicotiana tabacum; identical to SEQ ID NO: 316
  misc_feature (1)..(413): Public GI No. 485943
  misc_feature (1)..(413): Functional Homolog of  Ceres CLONE ID no. 3997 at SEQ ID NO. 467 with e-value of 0.0 and percent identity of 92.9

SEQ ID NO: 473 - protein, 413 aa, Nicotiana tabacum
  misc_feature (1)..(413): Public GI No. 2119932
  misc_feature (1)..(413): Functional Homolog of  Ceres CLONE ID no. 3997 at SEQ ID NO. 467 with e-value of 0.0 and percent identity of 91.9
MAGAAPEGSQFDARQYDSKMTELLNAEGQEFFTSYDEVYHSFDAMGLKENLLRGIYAYGFEKPSAIQQRGIVPFCKGLDVIQQAQSGTGKTATFCSGVLQQLDYELLECQALVLAPTRELAQQIEKVMRALGDYLGVKVHACVGGTSVREDQRILSSGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVSINFVTSDDERMLSDIQRFYNVVIEELPANVADLL

SEQ ID NO: 474 - protein, 414 aa, Oryza sativa subsp. japonica
  misc_feature (1)..(414): Public GI No. 53792733
  misc_feature (1)..(414): Functional Homolog of  Ceres CLONE ID no. 3997 at SEQ ID NO. 467 with e-value of 0.0 and percent identity of 91.7
MAGMAPEGSQFDAKHYDSKMQELLNQGETEEFFTSYDEVHESFDDMGLQENLLRGIYAYGFEKPSAIQQRGIVPFCKGLDVIQQAQSGTGKTATFCSGILQQLDYAVVECQALVLAPTRELAQQIEKVMRALGDYLGVKVHACVGGTSVREDQRILASGVHVVVGTPGRVFDMLRRQSLRPDYIKMFVLDEADEMLSRGFKDQIYDIFQLLPSKIQVGVFSATMPPEALEITRKFMNKPVRILVKRDELTLEGIKQFYVNVEKEEWKLDTLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVVIEELPANVADLL

SEQ ID NO: 475 - DNA, 525 bp, Arabidopsis thaliana
  misc_feature (1)..(525): Ceres CLONE ID no. 39985
  misc_feature (1)..(525): Also Known As Ceres GEMINI ID no. 553F6
aatcacttacttaacatactaagagagttattagatcttgaaaaacatggcttccaaggctttgattctgttgggtctcttcgcaattcttctggtggtctccgaagtttctgccgcaaggcagtcgggcatggtgaagccagagagtgaggaaactgtgcaacctgaaggttatcacggaggacatggtggtcacggagggggaggccactacggaggaggaggccacgggcatggaggacacaacggaggagggggccacggacttgacggatacggaggaggacatggaggacactacggaggaggaggaggtcacgggctgaacgaacctgttcagacgaagccgggtgtttaaaagttataactatcaaataaattcaccatgcataattgcatctctatatacacttatgtcttatatgtatccatcaaaataaaccatggtgagtttgtaatgcagttccttcagaaatgtgtggaataatgtttcacaataataatagaatatctctgttgattctg

SEQ ID NO: 476 - protein, 103 aa, Arabidopsis thaliana
  misc_feature (1)..(103): Ceres CLONE ID no. 39985
  misc_feature (1)..(103): Also Known As Ceres GEMINI ID no. 553F6
  misc_feature (1)..(95): Pfam Name: GRP Pfam Description: Glycine rich protein family
MASKALILLGLFAILLVVSEVSAARQSGMVKPESEETVQPEGYHGGHGGHGGGGHYGGGGHGHGGHNGGGGHGLDGYGGGHGGHYGGGGGHGLNEPVQTKPGV

SEQ ID NO: 477 - protein, 102 aa, Arabidopsis thaliana
  misc_feature (1)..(102): Ceres CLONE ID no. 20104
  misc_feature (1)..(102): Functional Homolog of  Ceres CLONE ID no. 39985 at SEQ ID NO. 476 with e-value of 3.00E-52 and percent identity of 97.0
MASKALILLGLFAILLVVSEVSAARHAGMVKPESEETVQPEGYHGGHGGHGGGGHYGGGGHGHGGHNGGGGHGLDGYGGGHGGHHGGGGHGLNEPVQTKPGV

SEQ ID NO: 478 - protein, 110 aa, Arabidopsis thaliana; identical to SEQ ID NO: 210
  misc_feature (1)..(110): Ceres CLONE ID no. 207629
  misc_feature (1)..(110): Also Known As Ceres GEMINI ID no. 531C2
  misc_feature (1)..(110): Functional Homolog of  Ceres CLONE ID no. 39985 at SEQ ID NO. 476 with e-value of 9.89E-45 and percent identity of 94.1

SEQ ID NO: 479 - protein, 127 aa, Arabidopsis thaliana
  misc_feature (1)..(127): Public GI No. 20197615
  misc_feature (1)..(127): Functional Homolog of  Ceres CLONE ID no. 39985 at SEQ ID NO. 476 with e-value of 2.10E-42 and percent identity of 96.0
MASKALILLGLFSVLLVVSEVSAARQSGMVKPESEETVQPEGYGGGHGGHGGHGGGGGHGHGGHNGGGGHGLDGYGGGGGHYGGGGGHYGGGGGHYGGGGGGYGGGGGHHGGGGHGLNEPVQTKPGV

SEQ ID NO: 480 - protein, 127 aa, Arabidopsis thaliana
  misc_feature (1)..(127): Ceres CLONE ID no. 105261
  misc_feature (1)..(127): Functional Homolog of  Ceres CLONE ID no. 39985 at SEQ ID NO. 476 with e-value of 3.49E-42 and percent identity of 95.0
MASKALILLGLFSVLLVVSEVSSARQSGMVKPESEETVQPEGYGGGHGGHGGHGGGGGHGHGGHNGGGGHGLDGYGGGGGHYGGGGGHYGGGGGHYGGGGGGYGGGGGHHGGGGHGLNEPVQTKPGV

SEQ ID NO: 481 - protein, 127 aa, Arabidopsis thaliana; identical to SEQ ID NO: 480
  misc_feature (1)..(127): Public GI No. 21536606
  misc_feature (1)..(127): Functional Homolog of  Ceres CLONE ID no. 39985 at SEQ ID NO. 476 with e-value of 4.39E-42 and percent identity of 95.0

SEQ ID NO: 482 - DNA, 1139 bp, Arabidopsis thaliana
  misc_feature (1)..(1139): Ceres CLONE ID no. 40736
  misc_feature (1)..(1139): Also Known As Ceres GEMINI ID no. 554H7
gtcactcggaattttttaaataataggatcgctttaataatataatctctataatttatagttccttttccaatattggcgtctccgttgaagctttccacaaatctcaaatttgtttggagactctcaaatgtatccttctctcgacgatgatttcgtctctgatttgttttgcttcgatcaaagcaatggagcagaacttgatgattacacacagtttggtgtaaatttgcagactgatcaagaggatacctttccagattttgtgtcatatggtgtgaatttgcagcaggagccagatgaagtctttagtattggagcttctcaattggatttgtcctcgtataatggagttttgtcgctagagccagaacaggtggggcaacaagattgtgaagttgtgcaggaagaagaagtagagatcaattctggttcatctggtggagctgttaaggaagaacaggaacatttagatgacgattgctccagaaagcgggcaaggactggatcgtgtagcagaggaggaggaactaaagcgtgtcgtgaaaggttgaggagggagaagctaaatgagaggtttatggatttgagctcggttttggagcctgggaggactcctaagactgataaaccggctatactcgatgatgcaatccgtatattgaatcaacttagagatgaagctcttaagcttgaagaaactaaccagaagcttttagaggagatcaagagtctcaaggcggagaagaacgagctgagggaggaaaagctggtgttgaaggcggataaagagaagacagaacaacagttaaagtctatgacggctccatcttcagggttcatacctcatattccagctgcatttaaccacaacaaaatggctgtttatccaagttacggttacatgccaatgtggcattatatgcctcaatccgttcgtgacacatctcgtgatcaagaactcaggcctcctgctgcttaaactctcaattgtttttttttggtacccatagggaactcatagagatttctgaatcacttggtttaggattcttccgtttggcaagtgtaaaagctttactcttgatcttgggttgtatttttcttataaaataaatataactccagaaacttgtgac

SEQ ID NO: 483 - protein, 283 aa, Arabidopsis thaliana
  misc_feature (1)..(283): Ceres CLONE ID no. 40736
  misc_feature (1)..(283): Also Known As Ceres GEMINI ID no. 554H7
  misc_feature (131)..(182): Pfam Name: HLH Pfam Description: Helix-loop-helix DNA-binding domain
MYPSLDDDFVSDLFCFDQSNGAELDDYTQFGVNLQTDQEDTFPDFVSYGVNLQQEPDEVFSIGASQLDLSSYNGVLSLEPEQVGQQDCEVVQEEEVEINSGSSGGAVKEEQEHLDDDCSRKRARTGSCSRGGGTKACRERLRREKLNERFMDLSSVLEPGRTPKTDKPAILDDAIRILNQLRDEALKLEETNQKLLEEIKSLKAEKNELREEKLVLKADKEKTEQQLKSMTAPSSGFIPHIPAAFNHNKMAVYPSYGYMPMWHYMPQSVRDTSRDQELRPPAA

SEQ ID NO: 484 - protein, 277 aa, Arabidopsis thaliana
  misc_feature (1)..(277): Public GI No. 20127109
  misc_feature (1)..(277): Functional Homolog of  Ceres CLONE ID no. 40736 at SEQ ID NO. 483 with e-value of 0.0 and percent identity of 98.5
MDVNLFGHDDSCSNGAELDDYTQFGVNLQTDQEDTFPDFVSYGVNLQQEPDEVFSIGASQLDLSSYNGVLSLEPEQVGQQDCEVVQEEEVEINSGSSGGAVKEEQEHLDDDCSRKRARTGSCSRGGGTKACRERLRREKLNERFMDLSSVLEPGRTPKTDKPAILDDAIRILNQLRDEALKLEETNQKLLEEIKSLKAEKNELREEKLVLKADKEKTEQQLKSMTAPSSGFIPHIPAAFNHNKMAVYPSYGYMPMWHYMPQSVRDTSRDQELRPPAA

SEQ ID NO: 485 - protein, 220 aa, Glycine max
  misc_feature (1)..(220): Ceres CLONE ID no. 590996
  misc_feature (1)..(220): Functional Homolog of  Ceres CLONE ID no. 40736 at SEQ ID NO. 483 with e-value of 1.19E-55 and percent identity of 71.5
MDSLEDSGCWDFLDYSFIDQAPPDFLWSNNNNSVSTEIDIPGDAVACQENTKKRGRTDSCFKAGSKACREKLRRERLNERFCDLSSVLEPGRPVRTDKPAILDDAIRVLSQLKTEAQELKKTNEKLLEEIKCLKAEKNELREEKLVLKADKERIEKQLKALPVAPAGFMAPPVAAAAAAYQAGVNKMAVYPNYGYIPMWQYLPQSVRDTSHDHELRPPAA

SEQ ID NO: 486 - protein, 218 aa, Glycine max
  misc_feature (1)..(218): Ceres CLONE ID no. 631135
  misc_feature (1)..(218): Functional Homolog of  Ceres CLONE ID no. 40736 at SEQ ID NO. 483 with e-value of 5.40E-53 and percent identity of 68.2
MDSLEDSGYWDFLDYSFIDQAPPDFLWSNNTISVNTEVDIPGDAAACQENTKKRGHADSSCQVGSKACREKLRRERLNERFCDLSSVLEPGRPVRTDKPAILDDAIRVLSQLKTEAQELKKTNEKLLEEIKCLKAEKNELREEKLVLKADKERIEKQLKALPVAPAGYMTPPVAAAAYQAGVNKMALYPNYGYIPMWQYLPQSVRDTSHDHELRPPAA

SEQ ID NO: 487 - DNA, 1342 bp, Arabidopsis thaliana
  misc_feature (1)..(1342): Ceres CLONE ID no. 42713
  misc_feature (1)..(1342): Also Known As Ceres CDNA ID no. 23375627
  misc_feature (1)..(1342): Also Known As Ceres GEMINI ID no. 554B2
atttgtttgccttcttctttctttctgactcaaacccttaaatcaattctcgcgattaagcaaaaccctagatttattctactcttcgaagtcgatttcaatggaaggttcctcgtcagccatcgcgaggaagacatgggagctagagaacaacattctcccagtggaaccaaccgattcagcctccgacagtatattccactacgacgacgcttcacaagccaaaatccagcaggagaagccatgggcctccgatcctaactacttcaagcgcgttcacatctcagcccttgctcttctcaagatggtggttcacgctcgctccggtggcacaatcgagatcatgggtcttatgcagggtaaaaccgagggtgatacaatcatcgttatggatgcttttgctttgcctgttgaaggtactgagactagggttaatgctcagtctgatgcctatgagtatatggttgaatactctcagaccagcaagctggctgggaggttggagaacgttgttggatggtatcactctcaccctgggtatggatgttggctctcgggtattgatgtttcgacacagatgcttaaccaacagtatcaggagccattcttagctgttgttattgatccaacaaggactgtttcggctggtaaggttgagattggggcattcagaacatatccagagggacataagatctcggatgatcatgtttctgagtatcagactatccctcttaacaagattgaggactttggtgtacattgcaaacagtactactcattggacatcacttatttcaagtcatctctcgatagtcaccttctggatctccttcggaacaagtactgggtgaacactctttcttcttccccactgttgggcaatggagactatgttgccgggcaaatatcagacttggctgagaagctcgagcaagcggagagtcagctcgctaactcccggtatggaggaattgcgccagccggtcaccaaaggaggaaagaggatgagcctcaactcgcgaagataactcgggatagtgcaaagataactgtcgagcaggtccatggactaatgtcacaggttatcaaagacatcttgttcaattccgctcgtcagtccaagaagtctgctgacgactcatcagatccagagcccatgattacatcgtgaagttggtctattcttttgttttttggctgcggaaattgactatcggtttgacccagtttatgaggcaatgcccattgttccctatatctctagtgtagtatctgcttcagacaaagatctttgggttattaaatgacattaacataaatcgatcattatgtttttgtg

SEQ ID NO: 488 - protein, 357 aa, Arabidopsis thaliana
  misc_feature (1)..(357): Ceres CLONE ID no. 42713
  misc_feature (1)..(357): Also Known As Ceres CDNA ID no. 23375627
  misc_feature (1)..(357): Also Known As Ceres GEMINI ID no. 554B2
  misc_feature (54)..(168): Pfam Name: Mov34 Pfam Description: Mov34/MPN/PAD-1 family
MEGSSSAIARKTWELENNILPVEPTDSASDSIFHYDDASQAKIQQEKPWASDPNYFKRVHISALALLKMVVHARSGGTIEIMGLMQGKTEGDTIIVMDAFALPVEGTETRVNAQSDAYEYMVEYSQTSKLAGRLENVVGWYHSHPGYGCWLSGIDVSTQMLNQQYQEPFLAVVIDPTRTVSAGKVEIGAFRTYPEGHKISDDHVSEYQTIPLNKIEDFGVHCKQYYSLDITYFKSSLDSHLLDLLRNKYWVNTLSSSPLLGNGDYVAGQISDLAEKLEQAESQLANSRYGGIAPAGHQRRKEDEPQLAKITRDSAKITVEQVHGLMSQVIKDILFNSARQSKKSADDSSDPEPMITS

SEQ ID NO: 489 - protein, 358 aa, Arabidopsis thaliana
  misc_feature (1)..(358): Public GI No. 21700803
  misc_feature (1)..(358): Functional Homolog of  Ceres CLONE ID no. 42713 at SEQ ID NO. 488 with e-value of 0.0 and percent identity of 85.6
MEGSSSTIARKTWELENSILTVDSPDSTSDNIFYYDDTSQTRFQQEKPWENDPHYFKRVKISALALLKMVVHARSGGTIEIMGLMQGKTDGDTIIVMDAFALPVEGTETRVNAQDDAYEYMVEYSQTNKLAGRLENVVGWYHSHPGYGCWLSGIDVSTQRLNQQHQEPFLAVVIDPTRTVSAGKVEIGAFRTYSKGYKPPDEPVSEYQTIPLNKIEDFGVHCKQYYSLDVTYFKSSLDSHLLDLLWNKYWVNTLSSSPLLGNGDYVAGQISDLAEKLEQAESHLVQSRFGGVVPSSLHKKKEDESQLTKITRDSAKITVEQVHGLMSQVIKDELFNSMRQSNNKSPTDSSDPDPMITY

SEQ ID NO: 490 - protein, 358 aa, Arabidopsis thaliana
  misc_feature (1)..(358): Public GI No. 3641312
  misc_feature (1)..(358): Functional Homolog of  Ceres CLONE ID no. 42713 at SEQ ID NO. 488 with e-value of 0.0 and percent identity of 85.6
MEGSSSTIARKTWELENSILTVDSPDSTSDNIFYYDDTSQTRFQQEKPWENDPHYFKRVKISALALLKMVVHARSGGTIEIMGLMQGKTDGDTIIVMDAFALPVEGTETRVNAQDDAYEYMVEYSQTNKLAGRLENVVGWYHSHPGYGCWLSGIDVSTQTLNQQHQEPFLAVVIDPTRTVSAGKVEIGAFRTYSKGYKPPDEPVSEYQTIPLNKIEDFGVHCKQYYSLDVTYFKSSLDSHLLDLLWNKYWVNTLSSSPLLGNGDYVAGQISDLAEKLEQAESHLVQSRFGGVVPSSLHKKKEDESQLTKITRDSAKITVEQVHGLMSQVIKDELFNSMRQSNNKSPTDSSDPDPMITY

SEQ ID NO: 491 - protein, 375 aa, Glycine max
  misc_feature (1)..(375): Ceres CLONE ID no. 529894
  misc_feature (1)..(375): Functional Homolog of  Ceres CLONE ID no. 42713 at SEQ ID NO. 488 with e-value of 0.0 and percent identity of 83.9
MQGKEMEGLSSSSAIAQKTWELENNIIPMDTPGGAATSSTATTTTNADDSIFYYDEAGQNEFQRDKPWANDPHYFKRVKISALALLKMVVHARSGGTIEVMGLMQGKTDADAIIVMDAFALPVEGTETRVNAQADAYEYMVDYSQTNKQAGRLENVVGWYHSHPGYGCWLSGIDVSTQMLNQQFQEPFLAVVIDPTRTVSAGKVEIGAFRTYPEGYKPPDEPISEYQTIPLNKIEDFGVHCKQYYALDITYFKSSLDSHLLDLLWNKYWVNTLSSSPLLGNGDYVAGQISDLAEKLEQAENQLAHSRFGPLIAPTPRKKEEESPLAKITRDSAKITVEQVHGLMSQVIKDILFNSVHQANRTRTEPSGPEPMIES

SEQ ID NO: 492 - protein, 357 aa, Medicago sativa
  misc_feature (1)..(357): Public GI No. 3320379
  misc_feature (1)..(357): Functional Homolog of  Ceres CLONE ID no. 42713 at SEQ ID NO. 488 with e-value of 0.0 and percent identity of 85.9
MEASSSSSSAIAQQTWELENNIIPMETPSDDSIFHYDEAGQAEFQRDKPWANDPHYFKRVKISALALLKMVVHARSGGTIEVMGLMQGKTDADSIIVMDAFALPVEGTETRVNAQADAYEYMVDYSQTNKQAGRLENVVGWYHSHPGYGCWLSGIDVSTQMLNQQFQEPFLAVVIDPTRTVSAGKVEIGAFRTYPEGYKPADDPISEYQTIPLNKIEDFGVHCKQYYSLDITYFKSSLDSHLLDLLWNKYWVNTLSSSPLLGNGDYVAGQISDLAEKLEQAENQLAHSRFGPLVAPTPRKKEEESPLAKITRDSAKITVEQVHGLMSQVIKDILFNSVHQANKSHTETSDPEPMIES

SEQ ID NO: 493 - protein, 367 aa, Lycopersicon esculentum
  misc_feature (1)..(367): Public GI No. 12002865
  misc_feature (1)..(367): Functional Homolog of  Ceres CLONE ID no. 42713 at SEQ ID NO. 488 with e-value of 0.0 and percent identity of 84.0
MDALNSYASSAAMAQQTWELENNIVTTDAPSGSAPENSASDAIFHYDDAAQTKFQREKPWTSDPHYFKRVKISALALLKMVVHARSGGTIEVMGLMQGKTDGDAIIVMDAFALPVEGTETRVNAQADAYEYMVEYSQTNKQAGRLENVVGWYHSHPGYGCWLSGIDVTTQMLNQQYQEPFLAVVIDPTRTVSAGKVEIGAFRTYPEGYKPPDDPISEYQTIPLNKIEDFGVHCKQYYSLDITYFKSSLDCHLLDLLWNKYWVNTLSSSPLLENGDYVAGQISDLAEKMEQAENHLSHSRFGHLVAAPQRKKEEESQLAKITRDSAKITVEQVHGLMSQVIKDILFNSVCKSGKSQTEPSDPEPMVET

SEQ ID NO: 494 - protein, 360 aa, Oryza sativa subsp. indica
  misc_feature (1)..(360): Public GI No. 50929277
  misc_feature (1)..(360): Functional Homolog of  Ceres CLONE ID no. 42713 at SEQ ID NO. 488 with e-value of 0.0 and percent identity of 80.2
MEPTSSAAMARQTWELENNIPAAASDPDALDAIYRYDEAAQARVQQEKPWANDPHPFRRAKISALALLKMVVHARAGGTIEVMGLMQGKCEGDAIVVMDAFALPVEGTETRVNAQADAYEYMVEYSTINKQAGRLENVVGWYHSHPGYGCWLSGIDVSTQMLNQQFQEPFLAVVIDPTRTVSAGKVEIGAFRTYPKDYKPPDEPVSEYQTIPLNKIEDFGVHCKQYYALDITYFKSSLDSHLLDLLWNKYWVNTLSSSPLLGNRDYVAGQIFDLADKLEQAEGQLAHSRYGMLMPSQRKKEQEESPLAKVTRDSSKITAEQVHGLMSQVIKDILFNSVHPSNKASTSAPDSSGPEPMVEA

SEQ ID NO: 495 - DNA, 1568 bp, Arabidopsis thaliana
  misc_feature (1)..(1568): Ceres CLONE ID no. 42960
  misc_feature (1)..(1568): Also Known As Ceres CDNA ID no. 23374793
  misc_feature (1)..(1568): Also Known As Ceres GEMINI ID no. 532F11
aaaaacaacaaagcaaagcgttgaagagagaagaagaagcaaagatataacccccaaaagtatcaattagtttccattttcgccgctaagattctgttttcgaacatttacaccctcaagaatcgccgccatgtgtggaggagctataatatccgatttcattccaccgccgaggtctcgccgtgttactagcgagtttatttggccggatctgaagaagaatttgaaaggatcgaagaaaagctcgaagaatcgttcgaatttcttcgattttgacgctgagttcgaagctgatttccaaggtttcaaagatgattcgtctatcgattgcgatgatgatttcgacgtcggtgatgttttcgccgatgtgaaaccattcgttttcacttcgactccaaaacccgccgtctccgccgctgcggaaggttcagtttttggtaagaaagttactggcttggatggggaagctgagaaatctgcaaataggaagaggaagaatcagtaccgagggattaggcaacgtccttggggaaaatgggctgctgagatacgtgatccaagggaaggtgctagaatctggcttggaacgttcaagacagctgaggaagctgctagagcttacgatgctgcagcgcggagaatccgtggatctaaagctaaggtgaatttccctgaagaaaacctgaaggctaattctcagaaacgctctgtgaaggctaatcttcagaaaccagtggctaaacctaaccctaacccaagtccagctttggttcagaactcgaacatctcctttgaaaatatgtgtttcatggaggagaaacaccaagtgagcaacaacaacaacaaccagtttgggatgacaaactccgttgatgctggatgtaatgggtatcagtatttcagctctgaccagggtagtaattctttcgattgttcggagtttggttggagcgatcaagctccgataactcccgacatctcttctgcggttatcaacaacaacaactcagctctgttctttgaggaagccaatccagctaagaagctcaagtctatggatttcgagacaccttacaacaacactgaatgggacgcttcactggatttcctcaacgaagatgctgtaacgactcaggacaatggtgcaaaccctatggacctatggagtattgatgaaattcattccatgattggaggagtcttctgaagagatccagtttcatgtaaataaggctgcatgtttgtgagtttcccgcatcgttcgtttatcaacctccaaaactttctaatgtctgttacttgcatcttcttctgctgtctctgtctgtctctctcaggagttcctgtttgcattgcgagaagccatgagcctctatcttgagggtagttgtgatgaagttaagtagaggcttatttttaggggttgtggtagtttttgttttagtgaatcttttgaattcgtttgtgttttgtttttgttactttatgccccaaaactcctttaacatttgtcataatgtgtttgaacctcctcatctgtttaatcaaataaatcttctttgtatgct

SEQ ID NO: 496 - protein, 358 aa, Arabidopsis thaliana
  misc_feature (1)..(358): Ceres CLONE ID no. 42960
  misc_feature (1)..(358): Also Known As Ceres CDNA ID no. 23374793
  misc_feature (1)..(358): Also Known As Ceres GEMINI ID no. 532F11
  misc_feature (123)..(186): Pfam Name: AP2 Pfam Description: AP2 domain
MCGGAIISDFIPPPRSRRVTSEFIWPDLKKNLKGSKKSSKNRSNFFDFDAEFEADFQGFKDDSSIDCDDDFDVGDVFADVKPFVFTSTPKPAVSAAAEGSVFGKKVTGLDGEAEKSANRKRKNQYRGIRQRPWGKWAAEIRDPREGARIWLGTFKTAEEAARAYDAAARRIRGSKAKVNFPEENLKANSQKRSVKANLQKPVAKPNPNPSPALVQNSNISFENMCFMEEKHQVSNNNNNQFGMTNSVDAGCNGYQYFSSDQGSNSFDCSEFGWSDQAPITPDISSAVINNNNSALFFEEANPAKKLKSMDFETPYNNTEWDASLDFLNEDAVTTQDNGANPMDLWSIDEIHSMIGGVF

SEQ ID NO: 497 - protein, 384 aa, Glycine max
  misc_feature (1)..(384): Public GI No. 33331083
  misc_feature (1)..(384): Functional Homolog of  Ceres CLONE ID no. 42960 at SEQ ID NO. 496 with e-value of 1.39E-63 and percent identity of 52.9
MCGGAIISDFIPAGPASGARRVTADILWPSLRKRFSKPLLDDDFEAGFREFKDDSEIEDVDDEDDEDEEELKKKPFGFSRSSNKAASKPLSRGATTVKSVESKGQAEKCAKRKRKNQYRGIRQRPWGKWAAEIRDPRKGVRVWLGTFSTAEEAARAYDAEARRIRGKKAKVNFPDEPSGAASSKRLKANPEAQPMKKNLNSVKPKINQMFNFGDNLEGYYSPIDQVEQKPLVNQYVNRAPFAGNGVQVSPVTPSADVTAYFSSEHSSNSFDYSDLGWGEQVPKTPEISSLLSAAPLEGAADQVQKTNNSQDVVAAQDDSAKTLSEELADIESQLKFFETPSFLDEAWADATLASLLGGDATHDAAGNPMNLWSFDDLPSMAGVF

SEQ ID NO: 498 - protein, 381 aa, Manihot esculenta
  misc_feature (1)..(381): Public GI No. 62526569
  misc_feature (1)..(381): Functional Homolog of  Ceres CLONE ID no. 42960 at SEQ ID NO. 496 with e-value of 3.50E-81 and percent identity of 58.4
MCGGAIISDFIPATAAGRSSRRLTADFLWPDLKKPIGKIVGDLDDDFEADFQEFKDESDVDEEDDVLFDVKPFSFSATASPPPRNRSPSRGSTAVKSVEFNGLAEKSAKRKRKNQYRGIRQRPWGKWAAEIRDPRKGVRVWLGTFNTAEEAARAYDAEARRIRGKKAKVNFPDEAPRASPKRTMKANPQKPLPKRNATESMSYLNNPDQDYFNTLGSVDEKPLVSQFDLMDSFPANGDATVKSIPPCDNVPTFFNSDQGSNSFECSDFGWGEQASKTPEISSVLSATPEIDESLFMDDANPKKKMKSDSENAVPIEESNGKSLSEELLAFDNQMNFQMPYLEGSWEASLDGFLNGDVTQDGGNPMDLWSFDDLPNMVGGVY

SEQ ID NO: 499 - protein, 369 aa, Capsicum annuum
  misc_feature (1)..(369): Public GI No. 37954364
  misc_feature (1)..(369): Functional Homolog of  Ceres CLONE ID no. 42960 at SEQ ID NO. 496 with e-value of 9.60E-63 and percent identity of 57.3
MCGGAIISDLVPPSRISRRLTAELLWGNSDLSKKKKNPGNYYSKPLNRSKFIDLDEEFEADFQDFKDYADDDVDDVKPFGSKSVKSGDSSCDTEKSSKRKRKNQYRGIRQRPWGKWAAEIRDPRKGIRVWLGTFNSAEEAARAYDVEARRIRGKKAKVNFPDGSPASASRRAVKPNPQEALREEILNTVQPNTTYINNLDGGSDDSFGFFEEKPAAKQYGYENVSFTAGDMGLGSISPSTGTTNVYFSSDEGSNTFDCSDFGWGEPCPRTPEISSVLSEVLECNGTQSDEDARPEKKLKSCSNASLPDEDNTVHTLSEELSAFESQMKFLQIPYLEGNWDASVDAFVNTGAIQDGGNAMDLWPSMMFLL

SEQ ID NO: 500 - protein, 372 aa, Lycopersicon esculentum
  misc_feature (1)..(372): Public GI No. 22074046
  misc_feature (1)..(372): Functional Homolog of  Ceres CLONE ID no. 42960 at SEQ ID NO. 496 with e-value of 3.39E-67 and percent identity of 55.8
MCGGAIISDLVPPSRISRRLTADFLWGTSDLNKKKKNPSNYHSKPLRSKFIDLEDEFEADFQHFKDNSDDDDDVKAFGPKSVRSGDSNCEADRSSKRKRKNQYRGIRQRPWGKWAAEIRDPRKGIRVWLGTFNSAEEAARAYDAEARRIRGKKAKVNFPDEAPVSVSRRAIKQNPQKALREETLNTVQPNMTYISNLDGGSDDSFSFFEEKPATKQYGFENVSFTAVDMGLGSVSPSAGTNVYFSSDEASNTFDCSDFGWAEPCARTPEISSVLSEVLETNETHFDDDSRPEKKLKSCSSTSLTVDGNTVNTLSEELSAFESQMKFLQIPYLEGNWDASVDAFLNTSAIQDGGNAMDLWSFDDVPSLMGGAY

SEQ ID NO: 501 - protein, 387 aa, Nicotiana tabacum
  misc_feature (1)..(387): Public GI No. 30961941
  misc_feature (1)..(387): Functional Homolog of  Ceres CLONE ID no. 42960 at SEQ ID NO. 496 with e-value of 4.40E-74 and percent identity of 55.8
MCGGAIISDYIAPSRTSRRLTAELLWGRSDLSNKQKNPNNYHSKPLRSQVVDLDDDFEADFQDFKDFSDDEDVQVDVKPFAFSASKNSNVEGSKSVKTDDSDKDADRSSKRKRKNQYRGIRQRPWGKWAAEIRDPRKGVRVWLGTFNTAEEAARAYDVEARRIRGNKAKVNFPDEAPVPASRRTVKVNPQKVLPKEILDSVQPDSTIINNMEDCCYDSLGFLEEKPMTKQFGCEDGSSASGDTGFGSFAPSAGTDIYFNSDVGSNSFDCSDFGWGEPCARTPEISSVLSAVIESNESQLVEDDTSPMKKLKSSPINPVADDGNTANKLSEELSAFETQMKFLQIPYLEGNWDASVDTFLNSSATQDGDNAMDLWSFDDVPSLLGGVF

SEQ ID NO: 502 - protein, 378 aa, Fagus sylvatica
  misc_feature (1)..(378): Public GI No. 38343926
  misc_feature (1)..(378): Functional Homolog of  Ceres CLONE ID no. 42960 at SEQ ID NO. 496 with e-value of 1.99E-78 and percent identity of 59.9
MCGGAIISDFIAPTGSRRLTADYLWGDRKKPISGKRFSKPVVDLDDEFELDFQGFKDEEESDIDEEEVLVQDVKPFTFSAPPSSGSKPVKSVEFNGQAEKSAKRKRKNQYRGIRQRPWGKWAAEIRDPRKGVRVWLGTFNTAEKAARAYDAEARRIRGKKAKVNFPDETPRASPKRSVKANLQKPLAKANLNSVQPNLNQNFNFMNNSDQDYTMGLMEEKPFTNQYGYMDSIPANADVGLKPFASNNTTPYFNSDQGSNSFDCSDYGWGEQGSKTPEISSVLSATLEGDESQFVEDAMPTKKLKSDSGNAVFIENNTAKTLSEELSAFESQMNFQMPFLEGSWESNMEALFSGDTTQDGNSMDLWSFDDLPVMAGGVL

SEQ ID NO: 503 - protein, 380 aa, Populus x canescens
  misc_feature (1)..(380): Public GI No. 57117316
  misc_feature (1)..(380): Functional Homolog of  Ceres CLONE ID no. 42960 at SEQ ID NO. 496 with e-value of 1.80E-70 and percent identity of 55.4
MCGGAIISGFIAPTTTARSSRRLTSGFEWLEPKKPFNNKHLKPVVADPEDDFEADLQEFKDESDVDEDYDVFADAKPFAFSASASEPAKKRGLPRGSTAVKSAGFSGLAKNSAKRKRKNQFRGIRQRPWGKWAAEIRDPRKGVRVWLGTFNTAEEAARAYDSEARRIRGKKAKVNFPDEAPCASARHPIKENSQKRLTKANLSQDFSYLSNPETDYNNMGFVEEKPQVSQFGIMNSIPVNGDSGVTPLTPSDNASMYFNSDKGSNSFDCDFGWGEQGAEILSVLAATPEVDESVFVEANPKKLKSYTEYAVPVEERNGKSLSEELLAFDNQLMNLQMPDLVGNWEASLDSFLNGDTTQDGTNAVDLWSFEDFPSMVGGVY

SEQ ID NO: 504 - DNA, 892 bp, Arabidopsis thaliana
  misc_feature (1)..(892): Ceres CLONE ID no. 45
  misc_feature (1)..(892): Also Known As Ceres CDNA ID no. 23389169
  misc_feature (1)..(892): Also Known As Ceres GEMINI ID no. 533E11
caaccattgttgcgtgtttggttatctcttctttcttctctctcacctaaatcaagggatttgttctgatcaactttgaacagaatttacaacaaatccctagaaaaatctgacccttccttcttcctctggaagatttaagatacttgttgataaggatattcggaagaagcttttgaaatttttggcaaaagtctcatttgatccgacttttctgttgaaggtgaaatagatacaaaaaaaaatgggctcagaggaaaacaacagcacaagctttccaccaacagagccaaagctctgtgataacggatgtggattcttcgggtcaccatccaacatgaatctctgctcgaaatgttacagaagcttaagagccgaggaagatcaaaccgcggtagcgaaagctgcggtgaagaactctttaaagcttccatcttgcagtatcattgcacctggacaaaaacatcctctggaaattaaaccagctcatttggaaaccgttgttgtaaccgctgagccgtcttcggtgcctgtagccgcggaacaggacgaggctgagccgtcgagacctgttagaccgaacaacaggtgtttcagctgtaacaagaaggttggtgtaatggggtttaagtgcaaatgcggtagcacgttttgcgggagtcataggtacccggagaagcatgagtgtagcttcgatttcaaagaagttggacgtgatgcaatcgcaaaggcgaatcctttggttaaggctgataaagttcagaggatttgaagaaaacaaactttgttatttttaagtatttctttgtcttctgcatttgatcagtttctgcctgggatgttcgatgtttggtttccatgaataaaaatgaaaattgctgctcttgctttc

SEQ ID NO: 505 - protein, 175 aa, Arabidopsis thaliana
  misc_feature (1)..(175): Ceres CLONE ID no. 45
  misc_feature (1)..(175): Also Known As Ceres CDNA ID no. 23389169
  misc_feature (1)..(175): Also Known As Ceres GEMINI ID no. 533E11
  misc_feature (116)..(156): Pfam Name: zf-AN1 Pfam Description: AN1-like Zinc finger
  misc_feature (16)..(40): Pfam Name: zf-A20 Pfam Description: A20-like zinc finger
MGSEENNSTSFPPTEPKLCDNGCGFFGSPSNMNLCSKCYRSLRAEEDQTAVAKAAVKNSLKLPSCSIIAPGQKHPLEIKPAHLETVVVTAEPSSVPVAAEQDEAEPSRPVRPNNRCFSCNKKVGVMGFKCKCGSTFCGSHRYPEKHECSFDFKEVGRDAIAKANPLVKADKVQRI

SEQ ID NO: 506 - protein, 172 aa, Brassica napus
  misc_feature (1)..(172): Ceres CLONE ID no. 962327
  misc_feature (1)..(172): Functional Homolog of  Ceres CLONE ID no. 45 at SEQ ID NO. 505 with e-value of 1.69E-60 and percent identity of 87.8
  misc_feature (143)..(143): Xaa is any aa, unknown, or other
  misc_feature (151)..(151): Xaa is any aa, unknown, or other
MSSEQNNSTSFPPTEPKLCDNGCGFFGSPSNMNLCSKCYRSLRAEEDQTAVAKAAVKNSLKLPSCSLIITPEQKQPLETKPASVVVTAEPSSVPIATGQEEAEPSKPARTNRCFSCNKKVGVMGFKCKCGSTFCGSHRYPEKXECSFDFKXVGRDAIAKANPVIKADKVERI

SEQ ID NO: 507 - protein, 175 aa, Zea mays
  misc_feature (1)..(175): Ceres CLONE ID no. 1360570
  misc_feature (1)..(175): Functional Homolog of  Ceres CLONE ID no. 45 at SEQ ID NO. 505 with e-value of 1.19E-59 and percent identity of 83.9
MSSEQNNSTSFPPTEPKLCDNGCGFFGSPSNMNLCSKCYRSLRAEEDQTAVAKAAVEKSLKLPSCNLITAPEPKQPLETKPASLETVVIAGTSSVPPVATGQDEGEPSKPTRPNRCFSCNKKVGVMGFKCKCGSTFCGSHRYPEKHECSFDFKEVGRGAIAKANPVVKADKVQRI

SEQ ID NO: 508 - DNA, 1261 bp, Glycine max
  misc_feature (1)..(1261): Ceres CLONE ID no. 471089
  misc_feature (1)..(1261): Also Known As Ceres CDNA ID no. 23662829
  misc_feature (1)..(1261): Also Known As Ceres GEMINI ID no. 540E4
aaaattccccaaagggtgtgttctgttttcgctcattctagaaacacccataagtcggcattacaagcaccatatttcggaagctggaagctcacacatttttttctgcgtccgagaatcgcatttttctagttcctgcgcatccaaacgagtccttaatatcgaactttcctgaagatggtgttgatagagcatgaagagagcaagcagagaaacgcgaacccctccaacgccgccaacgacgattccgacggcttcgaaaccgccagcgacaccgatctggccggtgaaggcgacgacagtggggccggcatcccggaagaacagaatcgcaccgaacagagtcataccgagaagcagacggagcaagagccggaacacgatgctcctcggagcagcaaatcatccgagaacaatgccctgatcagtgaagaagaatcgagacagaaagcattgaatcaagcaaatgaagcaaaggtagaagggaataagctttttgtagaagggaagtatgaagaggcattattacaatatgaacttgctttacaagcagcaccagacatgccttcatctgtggaaatacggtcaatatgccattcaaaccgtggtgtgtgctttctgaaactgggaaaatatgataacacaattaaagaatgcacaaaagcattagaattgaatcctgtgtacattaaagctttggtaagaagaggagaagctcatgaaaagcttgagcattttgaagaggctattgctgatatgaaaaagatcttagaaattgatctctcaaatgatcaagctaggaaaaccattaggcagctagagccccttgctgcagaaaaacgggaaaagatgaaggaggaaatgattgcaaaactgaaagacatgggcaattctgtcctgggccgctttgggatgagcgtagacaactttaaagcagtcaaagatccaaacactggttcctattctatctcattccaacgctaatttatgtagagcaaagtcataaacagcagcaagcaagaaagaggcagtctaaagtgatacaggttttagactcagttgtgcatgcaagttatttggaatatttgaatgttagttatgtatgagaactagggcatgtaacatttcctttgaaagggcatttaaactgcattaaggcttcagaacacatgtcaattgttttgaacttttgaaaaatactacattcgtccctatttatatgacgttgactaatttatgtatattagtattaaatttgtct

SEQ ID NO: 509 - protein, 268 aa, Glycine max
  misc_feature (1)..(268): Ceres CLONE ID no. 471089
  misc_feature (1)..(268): Also Known As Ceres CDNA ID no. 23662829
  misc_feature (1)..(268): Also Known As Ceres GEMINI ID no. 540E4
  misc_feature (171)..(204): Pfam Name: TPR_1 Pfam Description: Tetratricopeptide repeat
  misc_feature (96)..(129): Pfam Name: TPR_2 Pfam Description: Tetratricopeptide repeat
MVLIEHEESKQRNANPSNAANDDSDGFETASDTDLAGEGDDSGAGIPEEQNRTEQSHTEKQTEQEPEHDAPRSSKSSENNALISEEESRQKALNQANEAKVEGNKLFVEGKYEEALLQYELALQAAPDMPSSVEIRSICHSNRGVCFLKLGKYDNTIKECTKALELNPVYIKALVRRGEAHEKLEHFEEAIADMKKILEIDLSNDQARKTIRQLEPLAAEKREKMKEEMIAKLKDMGNSVLGRFGMSVDNFKAVKDPNTGSYSISFQR

SEQ ID NO: 510 - protein, 277 aa, Arabidopsis thaliana
  misc_feature (1)..(277): Public GI No. 21537266
  misc_feature (1)..(277): Functional Homolog of  Ceres CLONE ID no. 471089 at SEQ ID NO. 509 with e-value of 6.60E-80 and percent identity of 63.5
MVLIESSESEDEILIKNEPKPASSSSPQPTETKQVDGDDSDGFETASEREISDEEGEEDGTKNDAVTSQEEPQHSEKKEEQIELMSEGEAIVDDGSNKEKALAEANEAKAEGNKLFVNGLYEEALSKYAFALELVQELPESIELRSICYLNRGVCFLKLGKCEETIKECTKALELNPAYNKALVRRAEAHEKLEHFEDAVTDLKKILELDPSNDQARKGIRRLEPLAAEKREKMKEEAITKLKEMGNSILGRFGMSVDNFKAVKDPNTGSYSLSFQN

SEQ ID NO: 511 - protein, 255 aa, Zea mays
  misc_feature (1)..(255): Ceres CLONE ID no. 246144
  misc_feature (1)..(255): Functional Homolog of  Ceres CLONE ID no. 471089 at SEQ ID NO. 509 with e-value of 1.80E-70 and percent identity of 59.6
MVVIELEPEEATRPSSPASEEKAAAAAGGEAARPSSSAAPEEAPTAAAAAVGGEASRAAGEEEEAFEDALTDEQLREKSRSQANDAKAEGNKFFGSGQYEEALSKYEMALQIAAELESSEDIRAACHSNRAVCFLKLGKHDETVKECTKALELNPSYLKALLRRAEAHEKLEHYDEAIADMKKVIEMDPSNQQATRSLFRLEPLAAEKREKMKEEMIGKLKDLGNSVLGRFGMSVDNFKAVKDPNTGSYSIQFQK

SEQ ID NO: 512 - DNA, 1433 bp, Glycine max
  misc_feature (1)..(1433): Ceres CLONE ID no. 475689
  misc_feature (1)..(1433): Also Known As Ceres CDNA ID no. 23666761
  misc_feature (1)..(1433): Also Known As Ceres GEMINI ID no. 540H1
acaacacttccagtgatcatcttctccatccagaacgaacaaaaatggagaattcgacccaagaatcccacctccgatccgaaaactccgtgagctacgaatccccctacccaatctacggcatgtcgttctccccttcccacccccaccgcctggccctcggcagcttcattgaagaatacaccaaccgcgttgacatcctctccttccaccccgacaccctctccctcacccccaacccttctctctcctttgaccacccttaccctcccaccaaactcatgttccacccccgcaaacccccctcctcctcctccgacctcctcgccacctccggcgactacctccgcctctgggaggtccgcgacaactccgtggaggccgtctcccttttcaacaacagcaagaccagcgagttctgcgcccccttaacctccttcgactggaacgatatcgaccccaaccgcatcgccacctccagcatcgacaccacctgcaccatctgggacatcgaacgcaccctcgtcgaaacccaactcatcgcgcacgacaaagaggtctacgacatcgcatggggagaggccagagtcttcgcctccgtctccgccgacggctccgttagaatcttcgacctacgcgacaaggagcactccaccatcatctacgagagcccccaccctgacacccctctgctccgtttggcttggaacaaacaggacctgaggtacatggctactattttaatggacagtaataaagttgtgattttggatattaggtctcccactacccctgttgcggagttagagaggcaccgtgggagtgtgaacgctattgcttgggctcctcatagttccacgcatatttgttctgctggggatgatactcaggctcttatttgggatttgcccactctggcttctcccactgggattgatcccgtgtgtatgtattctgctggctgtgaaattaaccagctgcagtggtctgccgtgcagcccgaatggattgccattgcttttgccaacaagatgcagcttttgaaggtttgaggtgagtcgagggagaataaacacaattctagttactcaaacttgattgtgggatagataggactcctttcgcggatgctgcaacttcttagttctcgtggcttgtgtataagagtgagcgagttagtactatatataatactattgtagttgttgactgtaaaatagtttgccctcctcatgttttacttgtagcgaaattgatgatcaatttgtctgttgaggacagcttttagatacatgtatgtcctgttcaggatttaagattccatgtctgttgatgtggaagccataactattagtttcttagtaaacatgaaaaatcacatgtccagatgatagttgtaaaatgttcagtgtatgtattagcatttgattgtc

SEQ ID NO: 513 - protein, 335 aa, Glycine max
  misc_feature (1)..(335): Ceres CLONE ID no. 475689
  misc_feature (1)..(335): Also Known As Ceres CDNA ID no. 23666761
  misc_feature (1)..(335): Also Known As Ceres GEMINI ID no. 540H1
  misc_feature (127)..(155): Pfam Name: WD40 Pfam Description: WD domain, G-beta repeat
MENSTQESHLRSENSVSYESPYPIYGMSFSPSHPHRLALGSFIEEYTNRVDILSFHPDTLSLTPNPSLSFDHPYPPTKLMFHPRKPPSSSSDLLATSGDYLRLWEVRDNSVEAVSLFNNSKTSEFCAPLTSFDWNDIDPNRIATSSIDTTCTIWDIERTLVETQLIAHDKEVYDIAWGEARVFASVSADGSVRIFDLRDKEHSTIIYESPHPDTPLLRLAWNKQDLRYMATILMDSNKVVILDIRSPTTPVAELERHRGSVNAIAWAPHSSTHICSAGDDTQALIWDLPTLASPTGIDPVCMYSAGCEINQLQWSAVQPEWIAIAFANKMQLLKV

SEQ ID NO: 514 - protein, 345 aa, Gossypium hirsutum
  misc_feature (1)..(345): Public GI No. 22324807
  misc_feature (1)..(345): Functional Homolog of  Ceres CLONE ID no. 475689 at SEQ ID NO. 513 with e-value of 0.0 and percent identity of 81.4
MENSTQESHLRSDNSVTYESAYTVYAMALSSTPSSTNINHQRIALGSFLEDYTNRVDIISFDPETLSFKTHPKLAFDHPYPPTKLMFQPNRKSASSSSSCSDLLASTGDFLRLWEVRESSIEPVTVLNNSKTSEFCAPLTSFDWNDVEPKRIGTSSIDTTCTIWDIEKCVVETQLIAHDKEVYDIAWGEARVFASVSADGSVRIFDLRDKEHSTIIYESPQPDTPLLRLAWNKQDLKYMATIQMDSNKVVILDIRSPTTPVAELERHHASVNAIAWAPQSCKHICSAGDDTQALIWELPTVAGPNGIDPLCVYSAGYEINQLQWSAAQPDWIAIAFSNKLQLLKV

SEQ ID NO: 515 - protein, 341 aa, Arabidopsis thaliana
  misc_feature (1)..(341): Ceres CLONE ID no. 1151902
  misc_feature (1)..(341): Functional Homolog of  Ceres CLONE ID no. 475689 at SEQ ID NO. 513 with e-value of 0.0 and percent identity of 77.2
MDNSAPDSLSRSETAVTYDSPYPLYAMAFSSLRSSSGHRIAVGSFLEDYNNRIDILSFDSDSMTVKPLPNLSFEHPYPPTKLMFSPPSLRRPSSGDLLASSGDFLRLWEINEDSSTVEPISVLNNSKTSEFCAPLTSFDWNDVEPKRLGTCSIDTTCTIWDIEKSVVETQLIAHDKEVHDIAWGEARVFASVSADGSVRIFDLRDKEHSTIIYESPQPDTPLLRLAWNKQDLRYMATILMDSNKVVILDIRSPTMPVAELERHQASVNAIAWAPQSCKHICSGGDDTQALIWELPTVAGPNGIDPMSVYSAGSEINQLQWSSSQPDWIGIAFANKMQLLRV

SEQ ID NO: 516 - protein, 341 aa, Arabidopsis thaliana
  misc_feature (1)..(341): Public GI No. 10636051
  misc_feature (1)..(341): Functional Homolog of  Ceres CLONE ID no. 475689 at SEQ ID NO. 513 with e-value of 0.0 and percent identity of 76.8
MDNSAPDSLSRSETAVTYDSPYPLYAMAFSSLRSSSGHRIAVGSFLEDYNNRIDILSFDSDSMTVKPLPNLSFEHPYPPTKLMFSPPSLRRPSSGDLLASFGDFLRLWEINEDSSTVEPISVLNNSKTSEFCAPLTSFDWNDVEPKRLGTCSIDTTCTIWDIEKSVVETQLIAHDKEVHDIAWGEARVFASVSADGSVRIFDLRDKEHSTIIYESPQPDTPLLRLAWNKQDLRYMATILMDSNKVVILDIRSPTMPVAELERHQASVNAIAWAPQSCKHICSGGDDTQALIWELPTVAGPNGIDPMSVYSAGSEINQLQWSSSQPDWIGIAFANKMQLLRV

SEQ ID NO: 517 - protein, 342 aa, Malus x domestica
  misc_feature (1)..(342): Public GI No. 6752886
  misc_feature (1)..(342): Functional Homolog of  Ceres CLONE ID no. 475689 at SEQ ID NO. 513 with e-value of 0.0 and percent identity of 84.1
MENSTQESHLRAENSVTYESPYPLYAMAFASPQTRTRHQHHRIAVGSFIEEYSNRVDILSFDPDTLSIKPNPTLSFDHPYPPTKLMFHPNPNALHKTNDVLASSGDYLRLWEVGDSTVEPIQVLNNSKTSEFCAPLTSFDWNDIEPRRIGTSSIDTTCTIWDIEKGVVETQLIAHDKEVYDIAWGEARVFASVSADGSVRIFDLRDKEHSTIIYESPQPDTPLLRLAWNKQDLRYMATILMDSNKVVILDIRSPTMPVAELERHRGSVNAIAWAPQSCRHICSAGDDTQALIWDLPTVAGPNGIDPMSMYSAGAEINQLQWSAAQPDWISIAFSNKMQLLKV

SEQ ID NO: 518 - protein, 337 aa, Petunia x hybrida
  misc_feature (1)..(337): Public GI No. 2290532
  misc_feature (1)..(337): Functional Homolog of  Ceres CLONE ID no. 475689 at SEQ ID NO. 513 with e-value of 0.0 and percent identity of 78.1
MENSSQESQHLRSENSVTYDSTYPIYSMAFSSFPTPRRRIAVGSFIEELNNRVELLSFNEETLTLNPIPNLSFDHPYPPTKLMFHPNPIKSNNDILASSGDYLRLWEVKESSIEPLFTLNNSKTSEYCAPLTSFDWNEVEPKRIGTSSIDTTCTIWDVEKGVVETQLIAHDKEVYDIAWGEAGVFASVSADGSVRIFDLRDKEHSTIIYESPTPDTPLLRLAWNKQDLRYMATILMDSNKVVILDIRSPAMPVAELERHQASVNAIAWAPQSCRHICSGGDDGQALIWELPTVAGPNGIDPMSMYSAGAEINQLQWSPAQRDWIAIAFSNKLQLLKV

SEQ ID NO: 519 - protein, 356 aa, Triticum aestivum
  misc_feature (1)..(356): Ceres CLONE ID no. 783774
  misc_feature (1)..(356): Functional Homolog of  Ceres CLONE ID no. 475689 at SEQ ID NO. 513 with e-value of 1.60E-108 and percent identity of 68.3
MDQPKPTPSAAASPAGADAAPNPYAFTCELPHSIYALAFSPSAPVLAAGSFLEDLHNRVSLLCFDSVHPTAASFRAVPSLSFDHPYPPTKLQFNPRAASTPLLASSSDALRLWHAPLDDLSASAPAPELRSVLDNRKASASDFCAPLTSFDWNEIEPRRIGTASIDTTCTVWDIERGVVETQLIAHDKAVHDIAWGEAGVFASVSADGSVRVFDLRDKEHSTIVYESPRPDTPLLRLAWNRYDLRYMAALLMDSNAVVVLDIRAPGVPVAELHRHGGCVNAVAWAPQAARHLCSAGDDGQALIWELPEAPAAVPPEGIDPVLVYDAGAEINQLQWVAGHPDWMGISIENKVQLLRV

SEQ ID NO: 520 - protein, 353 aa, Zea mays
  misc_feature (1)..(353): Public GI No. 37544703
  misc_feature (1)..(353): Functional Homolog of  Ceres CLONE ID no. 475689 at SEQ ID NO. 513 with e-value of 5.39E-108 and percent identity of 67.0
MDPPKPPSSVASSSGPETPNPHAFTCELPHSIYALAFSPVAPVLASGSFLEDLHNRVSLLSFDPVRPSAASFRALPALSFDHPYPPTKLQFNPRAAAPSLLASSADTLRIWHTPLDDLSDTAPAPELRSVLDNRKASSEFCAPLTSFDWNEVEPRRIGTASIDTTCTVWDIDRGVVETQLIAHDKAVHDIAWGEAGVFASVSADGSVRVFDLRDKEHSTIVYESPRPDTPLLRLAWNRSDLRYMAALLMDSSAVVVLDIRAPGVPVAELHRHRACANAVAWAPQATRHLCSAGDDGQALIWELPETAAAVPAEGIDPVLVYDAGAEINQLQWAAAHPDWMAIAFENKVQLLRV

SEQ ID NO: 521 - protein, 355 aa, Oryza sativa subsp. japonica
  misc_feature (1)..(355): Public GI No. 50251896
  misc_feature (1)..(355): Functional Homolog of  Ceres CLONE ID no. 475689 at SEQ ID NO. 513 with e-value of 5.99E-109 and percent identity of 67.0
MEQPKPPSVAASAAEAQNPNAFTCELPHSIYALAFSPSAPVLAAGSFLEDLHNRVSLLSFDPVHPTAASFRALPALSFDHPYPPTKLQFHPRAASAPHLLASSSDALRLWLAPLDDLAATATAAAPELRSVLDNRKTSASEFCAPLTSFDWNEAEPRRIGTASIDTTCTIWDIERGVVETQLIAHDKAVHDIAWGENGIFASVSADGSVRVFDLRDKEHSTIFYESPRPDTPLLRLAWNRYDFHYMATLLMDSSAVVVLDMRAPGVPVAELHRHRACANAVAWAPQATRHLCSAGDDGQALIWELPATPGAVPAEGIDPVMVYDAGAEINQLQWAAAYPEWISIAFENKVQLLRV

SEQ ID NO: 522 - protein, 333 aa, Perilla frutescens
  misc_feature (1)..(333): Public GI No. 14270085
  misc_feature (1)..(333): Functional Homolog of  Ceres CLONE ID no. 475689 at SEQ ID NO. 513 with e-value of 0.0 and percent identity of 78.6
MENSTQESHPRPENVVTYDSPYPIYAMAISAVNRRRVAVGSFVEELKNHVDILSFSEDSSSLKPVPSLSFDHPYPPTKLLFHPSVSAPSNLLASSGDFLRLWEVKDSSIVAVSTLNNSKTSEYSAPLTSFDWNEVEPRRIGTSSIDTTCTIWDIEKGAVETQLIAHDKEVYDIAWGEAGVFASVSADGSVRIFDLRDKEHSTIIYESPMPDTPLLRLAWNKQDLRYMATILMDSNKIVILDIRSPTMPVAELERHSASVNAIAWAPQSCKHICSAGDDGQSLLWELPTVAGPNGIDPMTMYSAGAEINQLQWSAAQPDWIAIAFANKMQMLKV

SEQ ID NO: 523 - DNA, 1159 bp, Glycine max
  misc_feature (1)..(1159): Ceres CLONE ID no. 481710
  misc_feature (1)..(1159): Also Known As Ceres GEMINI ID no. 540C2
atatatatccctcactcactctatctcttttctccagcagcaccaaaaccacccaacactcgaactcaatatccattattaccaaaaaaaaagaaaaaaggatatcaaacacccttttcatcattaaaactctcagttccctctttccctatcaaaaccctttcccacaacactactcactccagtacaagaaaccctttttcaatttggtttcaacagcacacacacacacacatatatatatatatagcatgtttaccttgaatcattcttctgatttgtaccatgtttcccctgagctctcatcttccttggacacatcctcgccggcttcggagggctctcgtggcgtggcattttccgacgaggaggtgcggctggcggtgaggcacccgaagaagcgggcaggtcggaagaagttccgggagacgcgccacccggtgtaccggggggtgaggaggaggaactcggataagtgggtgtgtgaggtgagggagcccaacaagaagaccaggatttggctggggactttccccacgccggagatggcggctcgggcgcacgacgtggcggcaatggccctgaggggccggtatgcctgtctaaactttgctgactcggcctggcggttacctgttcccgccacggccgaggcaaaggatatacagaaggcagcagcagaagctgcccaggctttcagaccagatcaaaccttaaaaaatgctaatacaaggcaggagtgtgtggaggcggtggcggtggcggtggcggagacaacaacggcgacggcacaaggggtgttttatatggaggaagaagagcaggtgttggatatgcctgagttgcttaggaatatggtgctcatgtccccaacacattgcttagggtatgagtatgaagatgctgacttggatgcccaagatgctgaggtgtcactatggaatttctcaatttaataatgtgttttggtttggtttttgttgttagttttttggagtgaacagtgtctgtactggttttttattagtagtacggatactagttataggtggaaagattgcgagggaccaaaaggaattttcttttgaacccttttttgtcaatgtaatcaatatcacgtatatcatgaagtgaatcccttcaagtttatgtataaatt

SEQ ID NO: 524 - protein, 234 aa, Glycine max
  misc_feature (1)..(234): Ceres CLONE ID no. 481710
  misc_feature (1)..(234): Also Known As Ceres GEMINI ID no. 540C2
  misc_feature (63)..(126): Pfam Name: AP2 Pfam Description: AP2 domain
MFTLNHSSDLYHVSPELSSSLDTSSPASEGSRGVAFSDEEVRLAVRHPKKRAGRKKFRETRHPVYRGVRRRNSDKWVCEVREPNKKTRIWLGTFPTPEMAARAHDVAAMALRGRYACLNFADSAWRLPVPATAEAKDIQKAAAEAAQAFRPDQTLKNANTRQECVEAVAVAVAETTTATAQGVFYMEEEEQVLDMPELLRNMVLMSPTHCLGYEYEDADLDAQDAEVSLWNFSI

SEQ ID NO: 525 - protein, 231 aa, Glycine max
  misc_feature (1)..(231): Ceres CLONE ID no. 1620272
  misc_feature (1)..(231): Functional Homolog of  Ceres CLONE ID no. 481710 at SEQ ID NO. 524 with e-value of 9.99E-108 and percent identity of 90.8
MYTLNHSSYLYHVSPELSSSLDSSSPASEGSRGVAFSDEEVRLAVRHPKKRAGRKKFRETRHPVYRGVRRRNTDKWVSEVREPNKKTRIWLGTFPTPEMAARAHDVAAMALRGRYACLNFADSTWRLPIPATANAKDIQKAAAEAAEAFRPSQTLENTNTKQECVKVVTTTTITEQKRGMFYMEEEEQVLDMPELLRNMVLMSPTHCIGYEYEDADLDAQDAEVSLWSFSI

SEQ ID NO: 526 - protein, 215 aa, Capsicum annuum
  misc_feature (1)..(215): Public GI No. 37147896
  misc_feature (1)..(215): Functional Homolog of  Ceres CLONE ID no. 481710 at SEQ ID NO. 524 with e-value of 9.19E-58 and percent identity of 66.1
MNIFRSYYSDPLTESSSSFSDSSIYSPNRAIFSDEEVILASNNPKKPAGRKKFRETRHPVYRGVRKRNSGKWVCEVREPNKKSRIWLGTFPTAEMAARAHDVAAIALRGRSACLNFADSAWRLPVPASSDTKDIQKAAAEAAEAFRPLKLEGISKESSSSTPESMFFMDEEALFCMPGLLTNMAEGLMLPPPQCAEIGDHVETADADTPLWSYSI

SEQ ID NO: 527 - protein, 205 aa, Lycopersicon esculentum
  misc_feature (1)..(205): Public GI No. 45826358
  misc_feature (1)..(205): Functional Homolog of  Ceres CLONE ID no. 481710 at SEQ ID NO. 524 with e-value of 1.29E-52 and percent identity of 65.1
MFYSDPRIESCSSFSDSIRANHSDEEVILASNNPKKPAGRKKFRETRHPVYRGVRKRNSGKWVCEVREPNKKTRIWLGTFPTAEMAARAHDVAAIALRGRSACLNFADSAWRLPTPDSSDTKDIQKAAAQAAEIFRPLKSEEEESVVKDQSTTPDDMFFMDEEALFCMPGLLTNMAEGLMVPPPQCTEMGDHVEADDMPLWSYSI

SEQ ID NO: 528 - protein, 216 aa, Thellungiella salsuginea
  misc_feature (1)..(216): Public GI No. 41351817
  misc_feature (1)..(216): Functional Homolog of  Ceres CLONE ID no. 481710 at SEQ ID NO. 524 with e-value of 1.40E-51 and percent identity of 64.1
MNSFSAFAEMFGSEYESPVTVGGDYCPTLATSCPKKPAGRKKFRETRHPIYRGVRRRNSGKWVCEVREPNKKSRIWLGTFPTAEMAARAHDVAAIALRGRSACLNFADSAWRLRIPESTCAKDIQKAAAEAAVAFQAEMSDTMTSDHGLDMEETTVEVIVTEEEQSEGFYMDEEAMFGMPRLLANMAEGMLLPPPSVQWGHNYDCDGDADVSLWSY

SEQ ID NO: 529 - protein, 183 aa, Nicotiana tabacum
  misc_feature (1)..(183): Public GI No. 12003382
  misc_feature (1)..(183): Functional Homolog of  Ceres CLONE ID no. 481710 at SEQ ID NO. 524 with e-value of 1.50E-49 and percent identity of 63.8
MLASNNPKKRAGRKKLRETRHPVYRGVRKRNSGKWVCEVREPNKQSRIWLGTFPSAEMAVRAHDVAAIALRGRSACLNFADSAWKLHIPASTDAKDIQKAAAEAAEAFRTSEAENMPEYSGEDSKEVNSTPENMFYMDEEALFCMPGLLANMAEGLMLPPPQCSQIGDHMEDDFDMPLWSYSI

SEQ ID NO: 530 - protein, 220 aa, Triticum aestivum
  misc_feature (1)..(220): Ceres CLONE ID no. 1052602
  misc_feature (1)..(220): Functional Homolog of  Ceres CLONE ID no. 481710 at SEQ ID NO. 524 with e-value of 3.70E-53 and percent identity of 62.8
MDPFYTSFSDSFLSIPDHRSPVSDSSECSPKLASSCPKKLAGRKKFRETRHPIYRGVRQRNSGKWVCEVREPNKKSRIWLGTFPTVEMAARAHDVAALALRGRSACLNFADSAWRLRIPESTCPKEIQRAAAEAAMAFQNKTATTETTMVEAVKPAEETVGQTGGETMEENGVFYMAEEAVLGMPRFLENMGEEMLLPPPELGWNHNDLAGDADVSLWSF

SEQ ID NO: 531 - protein, 219 aa, Nicotiana tabacum
  misc_feature (1)..(219): Public GI No. 12003384
  misc_feature (1)..(219): Functional Homolog of  Ceres CLONE ID no. 481710 at SEQ ID NO. 524 with e-value of 1.10E-55 and percent identity of 62.6
MDIFRSYYSDPLAEYSSISDSSSSSCNRANHSDEEVMLASNNPKKRAGRKKFRETRHPVYRGVRKRNSDKWVCELREPNKKSRIWLGTFPSAEMAARAHDVAAIALRGRSACLNFADSAWKLPIPASTDAKDIQKAAAEAAEAFRSSEAENMPEYSGEDTKEVNSTPENMFYMDEEALFFMPGLLVNMAEGLMLPPPQCSQIGDHMEADVDMPLWSYSI

SEQ ID NO: 532 - protein, 214 aa, Brassica napus
  misc_feature (1)..(214): Public GI No. 5616086
  misc_feature (1)..(214): Functional Homolog of  Ceres CLONE ID no. 481710 at SEQ ID NO. 524 with e-value of 8.20E-49 and percent identity of 62.2
MTSFSTFSEMLGSEYESPVTLGGEYCPKLAASCPKKPAGRKKFRETRHPVYRGVRLRNSGKWVCEVREPNKKSRIWLGTFLTAEIAARAHDVAAIALRGKSACLNFADSAWRLRIPETTCPKEIQKAAAEAALAFQAEINNTTTDHGLDMEETIVEAIFTEENNDVFYMDEESMLEMPALLASMAEGMLLPPPSVHFGHNYDFDGDADVSLWSY

SEQ ID NO: 533 - protein, 214 aa, Brassica napus
  misc_feature (1)..(214): Public GI No. 38426952
  misc_feature (1)..(214): Functional Homolog of  Ceres CLONE ID no. 481710 at SEQ ID NO. 524 with e-value of 6.49E-49 and percent identity of 61.7
MTSFSAFSEMMGSENESPALSGEYCPTLAASCPKKPAGRKKFRETRHPIYRGVRQRHSGKWVCEVREPNKKSRIWLGTFLTAEIAARAHDVAAIALRGKSACLNFADSAWRLRIPETTCPKDIQKAAAEAAVAFQAEINDTTADHGIDVEETIVEAIFTEENNDGFYMDEEESMFGMPALLASMAEGMLLPPPSVQFGHTYDFDGDADVSLWSY

SEQ ID NO: 534 - protein, 214 aa, Brassica napus
  misc_feature (1)..(214): Public GI No. 38426948
  misc_feature (1)..(214): Functional Homolog of  Ceres CLONE ID no. 481710 at SEQ ID NO. 524 with e-value of 1.50E-49 and percent identity of 60.0
MTSFSAFSEMLGSEYESPTLSGEYCPTLAASCPKKPAGRKKFRETRHPIYRGVRLRNSGKWVCEVREPNKKSRIWLGTFLTAEIAARAHDVAAIALRGKSACLNFADSAWRLRIPETTCPKDIQKAAAEAAVAFQAEINDTTKDHGLDVEETIVEAIFTEENSDGFYMDEEESMFGMPTLLASMAEGMLLPPPSVQFEYNYDFDGDTDVSLWSY

SEQ ID NO: 535 - protein, 240 aa, Prunus avium
  misc_feature (1)..(240): Public GI No. 49658405
  misc_feature (1)..(240): Functional Homolog of  Ceres CLONE ID no. 481710 at SEQ ID NO. 524 with e-value of 5.30E-54 and percent identity of 58.0
MDMFFSQLSDSVDQPQSSLLSDASVTTRGASCSDGDVILASSRPKKRAGRRVFKETRHPVYRGVRRRNNDKWVCEMREPNKKKSRIWLGTYPTAEMAARAHDVAALAFRGKLACINFADSAWRLPVPASMDTMDIRRAAAEAAEGFRPVEFGGVCSGSSDEKERMVVQVEEKNKKGSVNLERSRSLSLSYWDEEEVFHMPRLLHDMAEGLLLSPSQCLGGYMNLDDMGTDADVKLWSFSI

SEQ ID NO: 536 - protein, 215 aa, Brassica napus
  misc_feature (1)..(215): Public GI No. 38146944
  misc_feature (1)..(215): Functional Homolog of  Ceres CLONE ID no. 481710 at SEQ ID NO. 524 with e-value of 1.50E-49 and percent identity of 57.5
MTSFSAFSELLGSEHESPVTLGEEYCPKLAASCPKKPAGRKKFRETRHPVYRGVRLRNSGKWVCEVREPNKKSRIWLGTFLTAEIAARAHDVAAIALRGKSACLNFADSAWRLRIPETTCPKDIQKAAAEAAVAFQAEINDTTTDHGLDVEETIVEAIFTEENNDGFYMDEEESMFGMPSLVASMAEGMLLPPPSVRFEHNYDFDGDADVSLWSY

SEQ ID NO: 537 - protein, 224 aa, Arabidopsis thaliana
  misc_feature (1)..(224): Public GI No. 10177734
  misc_feature (1)..(224): Functional Homolog of  Ceres CLONE ID no. 481710 at SEQ ID NO. 524 with e-value of 2.89E-53 and percent identity of 57.4
MNPFYSTFPDSFLSISDHRSPVSDSSECSPKLASSCPKKRAGRKKFRETRHPIYRGVRQRNSGKWVCEVREPNKKSRIWLGTFPTVEMAARAHDVAALALRGRSACLNFADSAWRLRIPETTCPKEIQKAASEAAMAFQNETTTEGSKTAAEAEEAAGEGVREGERRAEEQNGGVFYMDDEALLGMPNFFENMAEGMLLPPPEVGWNHNDFDGVGDVSLWSFDE

SEQ ID NO: 538 - protein, 219 aa, Capsella bursa-pastoris
  misc_feature (1)..(219): Public GI No. 38683266
  misc_feature (1)..(219): Functional Homolog of  Ceres CLONE ID no. 481710 at SEQ ID NO. 524 with e-value of 2.69E-50 and percent identity of 56.5
MNSSFSAFSEMFGSEYESPVSSGGGDYCPTLATSCPKKPAGRKKFRETRHPVYRGVRRRNSGKWVCEVREPNKKSRIWLGTFPTADMAARAHDVAAIALRGRSACLNFADSAWRLRIPESTGAKEIQKAAAEAALAFQDEMMMSDTTTTDHGFDMEETFVEAIVTAEQSASLYIDEEDMFGMPSLMASMAEGMLLPLPSVQWNHNYDIDGDDDVSLWSY

SEQ ID NO: 539 - DNA, 1640 bp, Glycine max
  misc_feature (1)..(1640): Ceres CLONE ID no. 481915
  misc_feature (1)..(1640): Also Known As Ceres CDNA ID no. 23675593
  misc_feature (1)..(1640): Also Known As Ceres GEMINI ID no. 540D6
aattaaaaaaagagaaaagcaactagagaaaaaaaaaaaagagaagaaaaaaaaacttggttttatcttctttgttattattatattcacttcttcaatatcttggttctttgatattattattcgattgagcaaaaaatgggagttccagagagagaccctcttgcacaattgagcttgcctcctggatttagattttatcccactgatgaggagcttttggttcagtacctttgccgcaaggttgctggccatcatttctctcttccaatcattgctgaagttgatttgtacaagtttgatccatgggttcttccaggtaaggcagcgtttggagagaaggagtggtacttcttcagtccaagagacaggaagtacccgaatggttcacgaccaaacagagttgcgggttctgggtattggaaagccactggaactgacaaaatcatcaccactgaaggtagaaaagttggcataaaaaaagcacttgttttctacgttggcaaagcacccaaaggctccaaaaccaattggatcatgcacgagtatcgccttctcgactcttcccgcaaacacaacctcggaaccgcaaagcttgatgattgggttctgtgtcgtatctataagaagaactcaagtgcgcaaaaggttgaggcaaatcttttggctatggaatgtagcaatgggtcatcaccttcttcatcgtcccacgtggacgacatgctggaatcgttgccggagatcgatgatcggtgcttcaccctgccgcgagtgaactcagtcagaacaatgcagcagcaggacgagaaattcggatttcagaacatgggatccgggtttttcaccgattgggtcaacccgacggatcttgattcagtttccgaatttgggtcgggttgccaaacccaagggatggtgaattatgattgtaatgacttatttgtcccttctgtgccgcccttcggccacagccatgtaaactacatggtgggggcaccaccgtccgaggaggaggttcaaagcggtgtgaggactcaacaggccgatggggccgcatgttttcagcagaacccaaatgcccgattgttaccgggctcgggcgacccatttgggtttgggttcatcatgggtcagcaagttgagttcgggtttagggactgaaggatctgatagtgttgttctgtaaataattggggattttaatttaaattctatgctcattgttatggaaaattgcaattttggtcattcttttcggctagacacatacaatgaatcggtatgaaactgagcaaggatgacccaatggtgctttcaccacagcaccgcatgctgaaaaattaattgctttgcaagacattattgggctaaatatgaatcacgttgtacttcaaagcattacatagcaactattttccaaatttaagtttagtttagagcattagatattgatatttttatgtggttggtgtcccatgcatccttgtagacaacctgatcaacaagcaatgaaccagctgtaaaattgtctagccttgctgattgtgaaaaaagtgagatccacgtgtgaagtgaacccccgtttaatgtgttaaataaatgggtttggattgattagttgaaaaaagttttcamctatg

SEQ ID NO: 540 - protein, 340 aa, Glycine max
  misc_feature (1)..(340): Ceres CLONE ID no. 481915
  misc_feature (1)..(340): Also Known As Ceres CDNA ID no. 23675593
  misc_feature (1)..(340): Also Known As Ceres GEMINI ID no. 540D6
  misc_feature (14)..(140): Pfam Name: NAM Pfam Description: No apical meristem (NAM) protein
MGVPERDPLAQLSLPPGFRFYPTDEELLVQYLCRKVAGHHFSLPIIAEVDLYKFDPWVLPGKAAFGEKEWYFFSPRDRKYPNGSRPNRVAGSGYWKATGTDKIITTEGRKVGIKKALVFYVGKAPKGSKTNWIMHEYRLLDSSRKHNLGTAKLDDWVLCRIYKKNSSAQKVEANLLAMECSNGSSPSSSSHVDDMLESLPEIDDRCFTLPRVNSVRTMQQQDEKFGFQNMGSGFFTDWVNPTDLDSVSEFGSGCQTQGMVNYDCNDLFVPSVPPFGHSHVNYMVGAPPSEEEVQSGVRTQQADGAACFQQNPNARLLPGSGDPFGFGFIMGQQVEFGFRD

SEQ ID NO: 541 - protein, 297 aa, Arabidopsis thaliana
  misc_feature (1)..(297): Ceres CLONE ID no. 38344
  misc_feature (1)..(297): Functional Homolog of  Ceres CLONE ID no. 481915 at SEQ ID NO. 540 with e-value of 2.69E-90 and percent identity of 69.4
MGVREKDPLAQLSLPPGFRFYPTDEELLVQYLCRKVAGYHFSLQVIGDIDLYKFDPWDLPSKALFGEKEWYFFSPRDRKYPNGSRPNRVAGSGYWKATGTDKIITADGRRVGIKKALVFYAGKAPKGTKTNWIMHEYRLIEHSRSHGSSKLDDWVLCRIYKKTSGSQRQAVTPVQACREEHSTNGSSSSSSSQLDDVLDSFPEIKDQSFNLPRMNSLRTILNGNFDWASLAGLNPIPELAPTNGLPSYGGYDAFRAAEGEAESGHVNRQQNSSGLTQSFGYSSSGFGVSGQTFEFRQ

SEQ ID NO: 542 - protein, 314 aa, Arabidopsis thaliana
  misc_feature (1)..(314): Public GI No. 7269595
  misc_feature (1)..(314): Functional Homolog of  Ceres CLONE ID no. 481915 at SEQ ID NO. 540 with e-value of 1.39E-86 and percent identity of 69.8
MGVREKDPLAQLSLPPGFRFYPTDEELLVQYLCRKVAGYHFSLQVIGDIDLYKFDPWDLPSKQTCFTFVGEYNCNYLGKALFGEKEWYFFSPRDRKYPNGSRPNRVAGSGYWKATGTDKIITADGRRVGIKKALVFYAGKAPKGTKTNWIMHEYRLIEHSRSHGSSKLDDWVLCRIYKKTSGSQRQAVTPVQACREEHSTNGSSSSSSSQLDDVLDSFPEIKDQSFNLPRMNSLRTILNGNFDWASLAGLNPIPELAPTNGLPSYGGYDAFRAAEGEAESGHVNRQQNSSGLTQSFGYSSSGFGVSGQTFEFRQ

SEQ ID NO: 543 - protein, 300 aa, Brassica napus
  misc_feature (1)..(300): Public GI No. 31322582
  misc_feature (1)..(300): Functional Homolog of  Ceres CLONE ID no. 481915 at SEQ ID NO. 540 with e-value of 5.79E-88 and percent identity of 76.8
  misc_feature (191)..(191): Xaa is any aa, unknown, or other
  misc_feature (255)..(255): Xaa is any aa, unknown, or other
MGVREKDPLAQLSLPPGFRFYPTDEELLVQYLCRKVAGYHFSLQIIGDIDLYKFDPWDLPSKALFGEKEWYFFSPRDRKYPNGSRPNRVAGSGYWKATGTDKIIMSDGHRVGIKKALVFYAGKAPKGTKTNWIMHEYRLIEHSRSHGSSKLDDWVLCRIYKKTSGSQRQAVASPVQACLEDQSTNMSSSPXSSSQLDDVLDSFPEMKDRSFDLPRMNSLRTILNGNFEWASLAGLNPMPELAPMTYGLSNYGGYXAFQSAESGCRSSQVDQEQNSTELTQSLGYSSSGFGLSGQMYEFRQ

SEQ ID NO: 544 - protein, 337 aa, Glycine max
  misc_feature (1)..(337): Public GI No. 62546187
  misc_feature (1)..(337): Functional Homolog of  Ceres CLONE ID no. 481915 at SEQ ID NO. 540 with e-value of 0.0 and percent identity of 91.0
MGVPERDPLAQLSLPPGFRFYPTDEELLVQYLCRKVAGHHFSLPIIAEVDLYKFDPWVLPGKAVFGEKEWYFFSPRDRKYPNGSRPNRVAGSGYWKATGTDKIITTEGRKVGIKKALVFYIGKAPKGSKTNWIMHEYRLLDSSRKHNLGTAKLDDWVLCRIYKKNSSSQKVEANFLAMECSNGSSPSSSSHVDDMLGSLPEINDRCFTLPRVNSLRTMHQQDEKFGSPNMGSGFFSDWVNSTDLDSISEFESGCQTQRMVNYDCNDFFVPSLPPLGHVDYMVDAPLEEEVQSGVRTRRVDGPGHFQPNPDTRLLPGSGDPFGFGFIMGQQVEFGFRD

SEQ ID NO: 545 - DNA, 1332 bp, Glycine max
  misc_feature (1)..(1332): Ceres CLONE ID no. 533314
  misc_feature (1)..(1332): Also Known As Ceres CDNA ID no. 23699071
  misc_feature (1)..(1332): Also Known As Ceres GEMINI ID no. 540F5
taaaattagggcttcggtttggtgtttttagtccttttgatgggcaacatctcaagcggcggcaatccccgtcgccgacacagcggagcttcacggcggagccacccgccgccgccgccgcccgttacgccgcagcctgagatcgcggcgaatccattcgtgtaccatggtgctgctgcaccgtacccgaaccctcctctgcattaccctcagtaccattaccccggttactaccctccggtgccacccatgccttatcatcctcatcaacatcaacatcatcatcgacacatggacccagcgtggattcaggggcatttccctagtgggcccatgatgcctaaccctgcacctttcgtagagcatcagaaagccgttacaataaagaacgatgtcaacatcaggaaagagacccttaagcttgaacccgacgtagaaaattctggccacttccttgtttcgttttccttcgatgccaccgtttctggcagcatcaccatatatttctttgcaaaagaaggtgaaggctgcatcctcacaccaatgaaggaaaaccaacttgcaccagtgtctgtgcatttcgagcaaggccttggccagaagtttagacaggcagctggaactggtattgatttttcagtgtttgaagagtctgagttattgaaagtgggtgaaaaggatgtctaccctctagcagtaaaggcagacgcatcccctggtaatcatgatgagtcagatagatctccaacatctagtaacacaaactctcagattacgcaaacgatgtttgagaaggagaaaggagagttccgggtgaaagttgtcaagcagatcttgtgggtgaatggaatgaggtatgagctgcaggagatatatggtattagaaattcaacggagaatgaccaaggaaaatgtgttatttgcttgtcagagccccgagatacaattgtccttccctgccggcatatgtgtatgtgtagcggatgtgcaaaggattctaggttccagacagatagatgctcaatttgcagacaaccagttgagaggctgttggagatataggtagggtctgaggagtgaggaagatacactgktaactcctcaagctttatgtacagcccaactgttatacttcaacatttctccgtgtcttcttttcatggtgtcaccttacttttctgtattttccaataatcagaaaaacaaaagaaaatgtaatttatataggacttgcgtttcaacatgaacgacaggctggcattgcacataatttgtacaagacaatgcctccaattagcttgtttgtctgtgcttataaatggcttccattct

SEQ ID NO: 546 - protein, 340 aa, Glycine max
  misc_feature (1)..(340): Ceres CLONE ID no. 533314
  misc_feature (1)..(340): Also Known As Ceres CDNA ID no. 23699071
  misc_feature (1)..(340): Also Known As Ceres GEMINI ID no. 540F5
MGNISSGGNPRRRHSGASRRSHPPPPPPVTPQPEIAANPFVYHGAAAPYPNPPLHYPQYHYPGYYPPVPPMPYHPHQHQHHHRHMDPAWIQGHFPSGPMMPNPAPFVEHQKAVTIKNDVNIRKETLKLEPDVENSGHFLVSFSFDATVSGSITIYFFAKEGEGCILTPMKENQLAPVSVHFEQGLGQKFRQAAGTGIDFSVFEESELLKVGEKDVYPLAVKADASPGNHDESDRSPTSSNTNSQITQTMFEKEKGEFRVKVVKQILWVNGMRYELQEIYGIRNSTENDQGKCVICLSEPRDTIVLPCRHMCMCSGCAKDSRFQTDRCSICRQPVERLLEI

SEQ ID NO: 547 - DNA, 1960 bp, Glycine max
  misc_feature (1)..(1960): Ceres CLONE ID no. 534311
  misc_feature (1)..(1960): Also Known As Ceres CDNA ID no. 23697027
  misc_feature (1)..(1960): Also Known As Ceres GEMINI ID no. 552G2
gatccatatgctatgcatatgcttattctctctctctctctctcaccattgatctgattactgcttgtgtactataaccaaattggagcaaccccttttgcatctgatcctagaatcacaagcctagctacccgttttctaccttctcatgacctgtaattggttgtgaaaaatgacgaggttgactcgtgattttggtgatacaatgcaaagagatgctgtgcctgcggtttcttctgatgttgtgtttgcttctagtcggtttcctaattacagaattggagctaacaatcagataatagagacaaaggatgacccaaaagtgctatcaatgaaggaggttgttgcacgtgagactgcacagctgttggaacaacataatcgtctctccgttcgtgaccttgctagtaaattcgagaagggtttggcggcggcagctaagttgtctgaagaggctagacttagagaggcagcatcattggaaaaacatgttcttttgaagaagcttagagatgcacttgaatccttaaaagggcgtgtggcaggcagaaacaaggatgatgtagaagaagctattgctatggttgaagctctagcagttcagttgactcagagggaaggggaactaatacaagagaaggcagaggtgaagaagcttgcaaattttcttaagcaggcttctgaagatgctaagaaacttgttgatgaggaaagagcttttgctcgtgctgaaattgaggatgccagagcagcagttcaaagagtggaagaggcacttcaagaacatgagagaatgtctcaagcttccgggaaacaggacctggagcaattaatgagggaggtccaagaggctcgaagaattaaaatgctgcatcagccaagcaaggtcatggatatggaacatgagcttcgagcattgaggtctcaacttgcagagaagactagacagtatcttcgacttcagaaggagttaacaaggacaaagaaaggtggggaaaatgttccacatttatatgaacttgaagggaatgaaacgttaggttcttatttgcaaattcaaccttgctctgataatgcccctgaagtttcgaaatgttcaattcagtggtatcgtgtatcatctgatggtgccaaaaaagaacttatctcaggagcaacaaaatcagtttatgcccctgaaccttttgatgttggacgcatattgcaagttgatattatttcagaaagcgagcacgtcacactttcaaccgctggtccaatagatccagctgctggtttgggaacctatgtagaggcactagtgcgcaaacatgacactgaattcaacgtggtagtaacacagatgaatggttcacatcatccaactgaatctattcatgtgcttcatgttggaaagatgaggattaaactttgtaagggaaagacaacaattgccaaagaatactattcaagttcaatgcagctttgtggagttcgcggaggtggaaatgccgctgcacaagcactattttggcagccaaagcaggggcattcttttgtattagcttttgaatcagagagagaaaggaatgctgccatcatgcttgcaaggagatttgcatttgactgtaatatcatgcttgctggaccagatgacagagctcctctagggacatgatgggcctccttacatcttatttccccccttgtaattatgagttttttctaccttgtattataagtgttatttcaacagtaaaatctaccttgttatattggtaagttagtaatgattcataccttgtggtctgaatcatttatataattttgtttcatcagtccaaggcatttttttatttgcctttgtgagtcgtaagttttaggttacattataattataatagaatccgtggctgccatgtcgaagtgtttgagatgctaattggttgtatttaatagacagacattcagacaattactg

SEQ ID NO: 548 - protein, 494 aa, Glycine max
  misc_feature (1)..(494): Ceres CLONE ID no. 534311
  misc_feature (1)..(494): Also Known As Ceres CDNA ID no. 23697027
  misc_feature (1)..(494): Also Known As Ceres GEMINI ID no. 552G2
MTRLTRDFGDTMQRDAVPAVSSDVVFASSRFPNYRIGANNQIIETKDDPKVLSMKEVVARETAQLLEQHNRLSVRDLASKFEKGLAAAAKLSEEARLREAASLEKHVLLKKLRDALESLKGRVAGRNKDDVEEAIAMVEALAVQLTQREGELIQEKAEVKKLANFLKQASEDAKKLVDEERAFARAEIEDARAAVQRVEEALQEHERMSQASGKQDLEQLMREVQEARRIKMLHQPSKVMDMEHELRALRSQLAEKTRQYLRLQKELTRTKKGGENVPHLYELEGNETLGSYLQIQPCSDNAPEVSKCSIQWYRVSSDGAKKELISGATKSVYAPEPFDVGRILQVDIISESEHVTLSTAGPIDPAAGLGTYVEALVRKHDTEFNVVVTQMNGSHHPTESIHVLHVGKMRIKLCKGKTTIAKEYYSSSMQLCGVRGGGNAAAQALFWQPKQGHSFVLAFESERERNAAIMLARRFAFDCNIMLAGPDDRAPLGT

SEQ ID NO: 549 - protein, 496 aa, Arabidopsis thaliana
  misc_feature (1)..(496): Public GI No. 23197970
  misc_feature (1)..(496): Functional Homolog of  Ceres CLONE ID no. 534311 at SEQ ID NO. 548 with e-value of 0.0 and percent identity of 79.5
MTRVTRDFRDSLQRDGVPAVSADVKFASSRFPNYRIGANDQIFDVKDDPKVMSMKEVVARETAQLMDQQKRLSVRDLAHKFEKGLAAAAKLSEEAKLKEATSLEKHVLLKKLRDALESLRGRVAGRNKDDVEEAIAMVEALAVQLTQREGELFIEKAEVKKLASFLKQASEDAKKLVDEERAFARAEIESARAAVQRVEEALREHEQMSRASGKQDMEDLMKEVQEARRIKMLHQPSRVMDMEYELRALRNQLAEKSKHFLQLQKKLAMCRKSEENISLVYEIDGTEALGSCLRVRPCSNDAPDLSKCTIQWYRSSSDGSKKELISGATKSVYAPEPFDVGRVLHADIIYDGHSLSLSTVGKIDPAAGLGSYVEALVRKHDVDFNVVVTQMSGEDHTSESIHLFHVGKMRIKLCKGKTVIAKEYYSSAMQLCGVRGGGNAAAQALYWQAKKGVSFVIAFESERERNAAIMLARRFACDCNVTLAGPEDRTETGQSP

SEQ ID NO: 550 - protein, 494 aa, Zea mays
  misc_feature (1)..(494): Ceres CLONE ID no. 504165
  misc_feature (1)..(494): Functional Homolog of  Ceres CLONE ID no. 534311 at SEQ ID NO. 548 with e-value of 0.0 and percent identity of 54.8
MTRASTIDFGRRKQSELFGSGPLRPANIIRNKFPTYKNGSNGIVIKLADGPEMPSLKEAVAKEATDLLDRCQRPSVRELTMKFEKGFNTATLLSNEAKWRHAALLERDILLKDLKSVLESLRGRVGGKNKDEIEESLSMVDILAIELSKREDELLRQKTEVTKIADTLKLASTDAKRIIDEERANARLEIESAKASVQKIQSALKEQEIFSQRTGKQDVDELKEEVQEARRVKMLHCPSKAMDIENEIQVLRDQLAEKSSDSLRLLKELELHRSYGENDMPLYELKGLETLGSTLRIVVHECASVDFSNSSIQWFRIQPEGSKQEIISGATKLVYAPEPHDVGRYIQAEVKSGGQISVAKTAGSIDPAAGLVEYVETLVRNPETDYNVVILQVNGVAQAADSVHVLCIGRLRMRLAKEKTVVAKEFYSSSMQLCGVRGGGDAAPQAIFWQPRNGLSFVLAFETTRERNSALMLARRFAIDCNIILGGPGDKTSW

SEQ ID NO: 551 - protein, 493 aa, Oryza sativa subsp. japonica
  misc_feature (1)..(493): Public GI No. 34909052
  misc_feature (1)..(493): Functional Homolog of  Ceres CLONE ID no. 534311 at SEQ ID NO. 548 with e-value of 0.0 and percent identity of 61.4
MTRVIHDSGEGMQKEALAMVSSDVNFPKGHFPDYKIGPNNQIIDPEEIHEAVPLKEIVAKETAQLLEQRRRLSVRDLKEKFEKGLSGASKLSEEAKRREAASLDRQVLLKKLRDVLDTLKGRVAGRNRDDADEAISLVEALAVQLTQREGELIYEKAEVKKLASFLKQATEDARKVAEEERALALAEIEKARTAIAIVEKGLQEHDAASSSREKEEIEGLRKEVREARRIKMLHQPSKVMDMEFELKALRTLIAEKNQLCNQLMKELAMIKRLEEDSSDLYDLEGSDILGSQFCIIPRFDDAPDISSCPTQWYRVISGGNRNLILGATKPTYAPEPFDVGRLLQAEIVLNAEKVTIQTMGPINPAAGLEHYVESLMKRADVEFNVVVTQMNGNDYSSNSVHAFHIGKMRIKLRKGWSTKARESYSTTMKLCGSRGGGNAAATAVFWQARKGLSYTLAFETDRDRNAAIMLARKFASNCNITLTGPGDEVHAGS

SEQ ID NO: 552 - protein, 482 aa, Oryza sativa subsp. japonica
  misc_feature (1)..(482): Public GI No. 55296828
  misc_feature (1)..(482): Functional Homolog of  Ceres CLONE ID no. 534311 at SEQ ID NO. 548 with e-value of 0.0 and percent identity of 61.8
MQKEALAMVSSDVNFPKGHFPDYKIGPNNQIIDPEEIHEAVPLKEIVAKETAQLLEQRRRLSVRDLKEKFEKGLSGASKLSEEAKRREAASLDRQVLLKKLRDVLDTLKGRVAGRNRDDADEAISLVEALAVQLTQREGELIYEKAEVKKLASFLKQATEDARKVAEEERALALAEIEKARTAIAIVEKGLQEHDAASSSREKEEIEGLRKEVREARRIKMLHQPSKVMDMEFELKALRTLIAEKNQLCNQLMKELAMIKRLEEDSSDLYDLEGSDILGSQFCIIPRFDDAPDISSCPTQWYRVISGGNRNLILGATKPTYAPEPFDVGRLLQAEIVLNAEKVTIQTMGPINPAAGLEHYVESLMKRADVEFNVVVTQMNGNDYSSNSVHAFHIGKMRIKLRKGWSTKARESYSTTMKLCGSRGGGNAAATAVFWQARKGLSYTLAFETDRDRNAAIMLARKFASNCNITLTGPGDEVHAGS

SEQ ID NO: 553 - DNA, 1402 bp, Glycine max
  misc_feature (1)..(1402): Ceres CLONE ID no. 553603
  misc_feature (1)..(1402): Also Known As Ceres GEMINI ID no. 540E3
gatgtccttcgtcttctcagcaaccccagatattccaaaacccagttacctgtctccgtgggaataggctagcttcagtgttcttaagccaaacccgtcaacgttcactgaaatccgtgagtgaataaatggttcctaattttctcattgcaaggttagctgtatcactcacacaccacagaagtacccatatccaattgggttctctgctgcaacacaaacgcaatgctttccttcttttattcaattcattcacttcaggaacctcttctgattctgaatcagatggaaaccaccaaaaaggtggcacctttactgtgtcttacctcatcaactcatgtggggtgtccccaacactggccaggaaactctccaataaggtcaatttgaaaaccccacatggcccaaatgctgttcttgatcttctcaacaactatgggtttgacaaaatccaggttgcaaaacttgttgagaaacaccctttggtgcttcttgcggatgcagagaatacccttttgcctaaactcaagttcttacgttctattggggtttccaacactgacatgcctaagattttaattgctaaccatagcttgaagaggagcttgaaaaaattcttcatcccaagatatgagatcctcagacgtgtacttggtgatgatcaggaagtcgttagagctataacaagttcccgatttggtattaattatggtgacgcaatgaacttggttccaaacattgaggttttgaggcagtctggtgtgccccaagcttctatctctttcatgatgatccattgtgggactgtagcctactggaagcattccagatttgtggaagctgtcaacactgctaaggaaatcgggtttaatcctttgagaacaaattttattgtggccattgaaatgcttctgattagcagcaaagcagtatgggaatcaaggtttaaggtttatgagaggtggggctggaaccgtgaaatggctcttcaagcatttcgaaagtttcccaatgtaatgaggttgtcagaggaggcatttagcaagaaaatgaatttcctagtgaatgatatgggttggccatcagaagaaatcgctgagtatcctcaagttgtagcatacaacttagagaagaggattatccctagattctcggtaatcaaaatcttgaaatcaaaaggtttgcttgagaataatgtatcctttagttccattatatgcataactgaagaaaaatttctggaaaattttgtgatcagtcttcagaaagatttgcctgtcttaccagacctctatagaggtaagatcaagccttcagatgtaatgtagtgtttgacggcttttgatggtacttatcctaacttccaacttgtctatttcaatgctaaattggactttgattc

SEQ ID NO: 554 - protein, 399 aa, Glycine max
  misc_feature (1)..(399): Ceres CLONE ID no. 553603
  misc_feature (1)..(399): Also Known As Ceres GEMINI ID no. 540E3
  misc_feature (290)..(372): Pfam Name: mTERF Pfam Description: mTERF
MVPNFLIARLAVSLTHHRSTHIQLGSLLQHKRNAFLLLFNSFTSGTSSDSESDGNHQKGGTFTVSYLINSCGVSPTLARKLSNKVNLKTPHGPNAVLDLLNNYGFDKIQVAKLVEKHPLVLLADAENTLLPKLKFLRSIGVSNTDMPKILIANHSLKRSLKKFFIPRYEILRRVLGDDQEVVRAITSSRFGINYGDAMNLVPNIEVLRQSGVPQASISFMMIHCGTVAYWKHSRFVEAVNTAKEIGFNPLRTNFIVAIEMLLISSKAVWESRFKVYERWGWNREMALQAFRKFPNVMRLSEEAFSKKMNFLVNDMGWPSEEIAEYPQVVAYNLEKRIIPRFSVIKILKSKGLLENNVSFSSIICITEEKFLENFVISLQKDLPVLPDLYRGKIKPSDVM

SEQ ID NO: 555 - protein, 402 aa, Glycine max
  misc_feature (1)..(402): Ceres CLONE ID no. 720248
  misc_feature (1)..(402): Functional Homolog of  Ceres CLONE ID no. 553603 at SEQ ID NO. 554 with e-value of 0.0 and percent identity of 83.5
MVPNFLIARLTASLSSFTHHRSTQTQLGSLLQHKHNAFLFFFNSFSSGTSSDSESDGNYHKGDTFTVSYLINSCGVSPRKAKELSNRINLKTPDGPNAVIDLLNNYGFTKTHLAKLVEKHPLVLVADAENTLLPKLKFFRSIGLSNTDMRKILIANHTLNRSLKKFFIPRYEILRRVLGDDQEVVRAITNSRFGFTYGDTMNLVPNIEVLRQSGVPQASITFLMINSATVAYWKHSRFVEAVNTAKEIGLNPLRTNFIVAVEMLLIRSKAVWESRFEVYERWGWNREMALQVFRKFPCVMKLSEETFAKKMSFLVKDMGWLSEDIAEYPQVIAYNLEKRIIPRFSVIKILKSKGLIENKLHLSAIICITEKKFLENFVVSFQKDLPLLPDVYGGKVKPSNVM

SEQ ID NO: 556 - DNA, 1217 bp, Glycine max
  misc_feature (1)..(1217): Ceres CLONE ID no. 556734
  misc_feature (1)..(1217): Also Known As Ceres CDNA ID no. 23693238
  misc_feature (1)..(1217): Also Known As Ceres GEMINI ID no. 553A4
gtattaatgccaacctcacccaaacttaagggctccccacaacgtaataacgtgcctgcccctatacctcaccccacttactattattattgtacaacacaaccaggtccctgaatgctttttagagagagaaagagtaataataataaagtggaagaaaaagaattaggagagtgaaacaagaagaagaagaagaagaagaagaagaagaattgagaagatggtgtttgaggaaactgagctgaggctgggactgggactatgtctccctggaaatggaaccacggcaacaactgaagctgctgctgcggaattaggagtgaggaagagagggttctctgagactgaaactgatgaaacagccaccgttgatttgatgcttaacctctcacccaaggaagctgctgctgctgatggtgcagatccacgtgagaagccaaagacttcgccgaaggagaagacccttctgcttcccgatcccgccaagcctcctgccaaggcgcaagtggtgggatggccacccgtgaggtctttccggaagaacatgttcgcagcccaaaagagcagcggcggagaggaaagcgaaaagagcagccctaatgcaagctttgtcaaagttagcatggatggagcaccttacctccgcaaagttgacttgaagatgtacaagagttacccagagctctctgatgccttgggcaaaatgtttagctccttcaccattggaaattgtgaatcccaaggcttcaaggatttcatgaatgagagcaagttgatggatcttttgaacagctccgactatgtcccgacctatgaagacagggatggcgactggatgcttgtcggtgatgtgccatgggagatgtttgttgaatcatgcaagcgtttacgtatcatgaaaggaaaggaagctattggactggcaccaagagccgtggagaaatgcaagaacaggagctagactagtagttaccagtccaaaatctgctccatcatcattagcggtgcctagttgacttagtaactgaagcaaggttaagctgcagcagacacagagggagagagcagggtgttaaaaaatatagttaagtaaatytgtgkatcattatggtttgttatataatatatatttcaaacaaagttgtkagatgtygtaagtataaattatgaacmcaaacgataatgactttaaattatgttgcaagactttyttattt

SEQ ID NO: 557 - protein, 246 aa, Glycine max
  misc_feature (1)..(246): Ceres CLONE ID no. 556734
  misc_feature (1)..(246): Also Known As Ceres CDNA ID no. 23693238
  misc_feature (1)..(246): Also Known As Ceres GEMINI ID no. 553A4
  misc_feature (1)..(238): Pfam Name: AUX_IAA Pfam Description: AUX/IAA family
MVFEETELRLGLGLCLPGNGTTATTEAAAAELGVRKRGFSETETDETATVDLMLNLSPKEAAAADGADPREKPKTSPKEKTLLLPDPAKPPAKAQVVGWPPVRSFRKNMFAAQKSSGGEESEKSSPNASFVKVSMDGAPYLRKVDLKMYKSYPELSDALGKMFSSFTIGNCESQGFKDFMNESKLMDLLNSSDYVPTYEDRDGDWMLVGDVPWEMFVESCKRLRIMKGKEAIGLAPRAVEKCKNRS

SEQ ID NO: 558 - protein, 230 aa, Cucumis sativus
  misc_feature (1)..(230): Public GI No. 5139697
  misc_feature (1)..(230): Functional Homolog of  Ceres CLONE ID no. 556734 at SEQ ID NO. 557 with e-value of 2.10E-76 and percent identity of 75.3
MEKKKMGFEETELRLGLPGNNNIGSSELGEVAARKRGFAETVSSETISKVDLKLNLSSKETVGVGDDDLVADSNPSNKDKAVLTADPAKPPAKAQVVGWPPVRSFRKNNMLAFVKVSMDGAPYLRKVDLKMYKSYKQLSDALAAMFGSFTTIGNCGSQEMKDFMNESKLMDLLSGSDYVPTYEDKDGDWMLVGDVPWEMFVESCKRLRIMKGKEAIGLAPRAMEKCKNRS

SEQ ID NO: 559 - protein, 248 aa, Glycine max
  misc_feature (1)..(248): Ceres CLONE ID no. 520455
  misc_feature (1)..(248): Functional Homolog of  Ceres CLONE ID no. 556734 at SEQ ID NO. 557 with e-value of 2.89E-118 and percent identity of 94.3
MVFEETELRLGLRLGLPGNGAAPTTEAAAELGVRKRGFSETETDETTSVDLMLNLSPKEASAAATTDGADPRENPKTSPKDKNLPLLDPAKPPAKAQVVGWPPVRSFRKNMFAAQKSSGGEESEKNSPNASFVKVSMDGAPYLRKVDLKMYKSYPELSDALGKMFSSFTIGNCESQGFKDFMNESKLMDLLNSSDYVPTYEDRDGDWMLVGDVPWEMFVESCKRLRIMKGKEAIGLAPRAVEKCKNRS

SEQ ID NO: 560 - protein, 252 aa, Glycine max
  misc_feature (1)..(252): Ceres CLONE ID no. 574451
  misc_feature (1)..(252): Functional Homolog of  Ceres CLONE ID no. 556734 at SEQ ID NO. 557 with e-value of 8.29E-96 and percent identity of 88.0
MEVGLKKENMGFEETELRLGLPGNGGTEEVLIRKRGFSETETGHEDESATTVDLMLNLSSKEAATTAAAAADPTDKHKTLPKEKTLLPADPAKPPAKTQVVGWPPVRSFRKNMLAVQKSVGEESEKNSSPNASFVKVSMDGAPYLRKVDLKMYKSYRELSDSLGKMFSSFTFGNCESQGMKDFMNESKLNDLLNSSDYVPTYEDKDGDWMLVGDVPWEMFVESCKRLRIMKGKEAIGLGLAPRAMAKCKNRS

SEQ ID NO: 561 - protein, 243 aa, Glycine max
  misc_feature (1)..(243): Public GI No. 114734
  misc_feature (1)..(243): Functional Homolog of  Ceres CLONE ID no. 556734 at SEQ ID NO. 557 with e-value of 1.10E-95 and percent identity of 88.0
MGFEETELRLGLPGNGGTEEVLIRKRGFSETETGHEDESATTVDLMLNLSSKEAATTAAAAADPTDKHKTLPKEKTLLPADPAKPPAKTQVVGWPPVRSFRKNMLAVQKSVGEESEKNSSPNASFVKVSMDGAPYLRKVDLKMYKSYRELSDSLGKMFSSFTFGNCESQGMKDFMNESKLNDLLNSSDYVPTYEDKDGDWMLVGDVPWEMFVESCKRLRIMKGKEAIGLGLAPRAMAKCKNRS

SEQ ID NO: 562 - protein, 227 aa, Glycine max
  misc_feature (1)..(227): Ceres CLONE ID no. 1113630
  misc_feature (1)..(227): Functional Homolog of  Ceres CLONE ID no. 556734 at SEQ ID NO. 557 with e-value of 2.40E-73 and percent identity of 77.5
MINFEETELRLGLPGNDSALKGSAAKRGFSETASVDLKLNLSSCINDSASDSPSSVSTEKPKENKTTTAEPPPANDPAKPPAKAQVVGWPPVRSFRKNIVQRNSNEEEAEKSTKNAFVKVSMDGAPYLRKVDIKLYKSYQELSDALAKMFSSFTIEKCGSQGMKDFMNETNGSDYVPTYEDKDGDWMLVGDVPWEMFVESCKRLRIMKGSEAIGLAPRAVEKCKNRS

SEQ ID NO: 563 - protein, 252 aa, Glycine max
  misc_feature (1)..(252): Ceres CLONE ID no. 1069818
  misc_feature (1)..(252): Functional Homolog of  Ceres CLONE ID no. 556734 at SEQ ID NO. 557 with e-value of 7.49E-63 and percent identity of 71.7
  misc_feature (157)..(157): Xaa is any aa, unknown, or other
MAGLGFEETKLRLGLPGGSNEAEEAAAAVRSSGKRGYAETIDLVLKLEPASVAAPPFEDDEEVADGVAEAQPSPAAADGQLKRSPSQCSVVTAAQPDADPEKPRAPKAQAVGWPPVRSFRRNMLAATAERGGAALVKVSMDGAPYLRKVDMGTYKSXQELSKALEKMFSSFTIGNDCSQAQGMTGMNESKLVDLLNGSDYVPTYEDKDGDWMLVGDVPWEMFVASCKRLRIMKGSEAIGLAPRAMEKCKSRS

SEQ ID NO: 564 - protein, 233 aa, Oryza sativa subsp. japonica
  misc_feature (1)..(233): Public GI No. 50917147
  misc_feature (1)..(233): Functional Homolog of  Ceres CLONE ID no. 556734 at SEQ ID NO. 557 with e-value of 6.69E-55 and percent identity of 69.7
MAGLGFDETELRLGLPGAGELAARSSGKRGFAETIDLKLKLQPAAPAAVSGEEGAQEDKEDADAAAAAADEKMSMKRSASQSSVVTAEPDPDKPRAPKAQVVGWPPVRSFRKNVLAEKCKAAALVKVSMDGAPYLRKIDVAMYKSYPELSMAFQNMFTSFTIGKCGSHQQLKESNKLRDDLEYVPTYEDKDGDWMLVGDVPWEMFVESCKRLRIMKGSEAIGLAPRAVEKCKS

SEQ ID NO: 565 - DNA, 771 bp, Glycine max
  misc_feature (1)..(771): Ceres CLONE ID no. 560681
  misc_feature (1)..(771): Also Known As Ceres GEMINI ID no. 537C3
atatatcttagccttttctctccctcccttctcccatattatatagcttgtcttttatttcttagactccatccattcttctccccaattgaatcttctttattttgtttcttcactgtctcgttatggctatagttttgcatagtaaataaactgaactgaagctatctatatagcagcaagtgttgatttaattacttactttagacaataattatattaattacaccaatttataagctctttatctatctatctagctagggaaaattaaaatgtctagcagaaggtccaggcagcaatctgcatccacaaggatctccgatgaccaaatcatcgacctcgtttcaaagttgcgtcaacttgttcctgagattcgcgataggcgctctgacaaggtatcagcatctaaggtcctacaagagacctgcaactacatcagaagcttacacagagaagtggatgacttaagcgaacgactgtctcagttgttggccacaatcgatgctgatagccctgaagctgccatcattaggagcctaattaactaataatatatattaagcgcaagtaatcatctaattttcctatattcaaggagatatattataagagtgtattaatttcttcttytaaattaggtggcatagagtgcagtttgaggtgcgtacgtacgtccttccaatatattatagtacatggcaggaatggtgcacttgtgtaagttaaaggtttttgcaataagaactaaggactctctgtattatggcg

SEQ ID NO: 566 - protein, 91 aa, Glycine max; identical to SEQ ID NO: 387
  misc_feature (1)..(91): Ceres CLONE ID no. 560681
  misc_feature (1)..(91): Also Known As Ceres GEMINI ID no. 537C3
  misc_feature (25)..(59): Pfam Name: HLH Pfam Description: Helix-loop-helix DNA-binding domain

SEQ ID NO: 567 - protein, 92 aa, Arabidopsis thaliana
  misc_feature (1)..(92): Public GI No. 9294226
  misc_feature (1)..(92): Functional Homolog of  Ceres CLONE ID no. 560681 at SEQ ID NO. 566 with e-value of 9.69E-31 and percent identity of 78.8
MSNRRSRQTSNASRISDDQMIDLVSKLRQFLPEIHERRRSDKVSASKVLQETCNYIRKLHREVDNLSDRLSQLLDSVDEDSPEAAVIRSLLM

SEQ ID NO: 568 - protein, 92 aa, Brassica napus; identical to SEQ ID NO: 386
  misc_feature (1)..(92): Ceres CLONE ID no. 951040
  misc_feature (1)..(92): Functional Homolog of  Ceres CLONE ID no. 560681 at SEQ ID NO. 566 with e-value of 5.29E-30 and percent identity of 76.6

SEQ ID NO: 569 - protein, 93 aa, Brassica napus
  misc_feature (1)..(93): Ceres CLONE ID no. 966938
  misc_feature (1)..(93): Functional Homolog of  Ceres CLONE ID no. 560681 at SEQ ID NO. 566 with e-value of 1.60E-28 and percent identity of 75.5
MSNRIRSRQSSSATRISDDQMIDLVGKLRQFLPEIRERRRSDKVSASKVLQDTCNYIRKLHREVDNLSDRLSLLLDSVDEDSQEAAVIRNLLM

SEQ ID NO: 570 - protein, 92 aa, Glycine max
  misc_feature (1)..(92): Ceres CLONE ID no. 560948
  misc_feature (1)..(92): Functional Homolog of  Ceres CLONE ID no. 560681 at SEQ ID NO. 566 with e-value of 4.39E-35 and percent identity of 89.0
MSSRRSRQHSGSTRISDDQIIELVSKLRQLVPEIRNRRSDKVSASKVLQETCNYIRGLHREVSDLSERLSQLLTTIDADSAEAGIIRSLLNQ

SEQ ID NO: 571 - protein, 92 aa, Glycine max
  misc_feature (1)..(92): Ceres CLONE ID no. 653656
  misc_feature (1)..(92): Functional Homolog of  Ceres CLONE ID no. 560681 at SEQ ID NO. 566 with e-value of 2.90E-29 and percent identity of 82.9
MSSRRSRSRQTSSSRNITDDQINDLVSKLQQLLPEIRDRRSDKVSASKVLQETCNYIRSLHREVDDLSERLSELLATTDTAQAAIIRNLLMQ

SEQ ID NO: 572 - protein, 92 aa, Glycine max
  misc_feature (1)..(92): Ceres CLONE ID no. 663844
  misc_feature (1)..(92): Functional Homolog of  Ceres CLONE ID no. 560681 at SEQ ID NO. 566 with e-value of 6.99E-28 and percent identity of 80.6
MSSRRSRSRQTSSSRNITDDQINDLVSKLQQLLPEIRDRRSDKVSASKVLQETCNYIRSLHREVGDLSERLSELLDTTDTAQAAIIRNLLMQ

SEQ ID NO: 573 - protein, 86 aa, Zea mays; identical to SEQ ID NO: 388
  misc_feature (1)..(86): Ceres CLONE ID no. 280170
  misc_feature (1)..(86): Functional Homolog of  Ceres CLONE ID no. 560681 at SEQ ID NO. 566 with e-value of 4.90E-20 and percent identity of 66.2

SEQ ID NO: 574 - protein, 88 aa, Oryza sativa subsp. japonica
  misc_feature (1)..(88): Public GI No. 50912765
  misc_feature (1)..(88): Functional Homolog of  Ceres CLONE ID no. 560681 at SEQ ID NO. 566 with e-value of 4.90E-20 and percent identity of 60.4
MSSRRSSRGSISEEEINELISKLQSLLPNSRRRGSSQASTTKLLKETCNYIKSLHREVDDLSDRLSDLMATMDHNSPGAEIIRSILRS

SEQ ID NO: 575 - DNA, 581 bp, Glycine max
  misc_feature (1)..(581): Ceres CLONE ID no. 560731
  misc_feature (1)..(581): Also Known As Ceres GEMINI ID no. 537H2
aatatgttgctactcatcactcactctcatcaccaacattttttaacagtcatttggaattatatcaccttacctctgatgttttaaaaatcttcatcatttgctccctctccacccttaaactggacatgctcgattctgtgcttctggcgcttttcttgccgtgcctcggcatgagcgccgttttcatcgtctacatgtgccttctctggtacgccaccaaccaccactccgaccccgcgctaccggccaagcctgtctccgacaccggaatctccccttcccagctcgacaagctccccagaatcaccggaaaggaccttctcatgggaaacgaatgcgccgtctgcctggacgagatcggaacagagcaaccggttcgggtggttcccggttgcaaccacgccttccatttggaatgcgccgacacctggctctccaagcaccctctctgccctctctgcagagccaaactcgacccttcgcttttctcttcttcccaaaatccatgctgaccaacaagctctagcgcaaagttggtagatgcatgacccagtttcttaaatatttcttgactgtat

SEQ ID NO: 576 - protein, 128 aa, Glycine max
  misc_feature (1)..(128): Ceres CLONE ID no. 560731
  misc_feature (1)..(128): Also Known As Ceres GEMINI ID no. 537H2
  misc_feature (71)..(112): Pfam Name: zf-C3HC4 Pfam Description: Zinc finger, C3HC4 type (RING finger)
MLDSVLLALFLPCLGMSAVFIVYMCLLWYATNHHSDPALPAKPVSDTGISPSQLDKLPRITGKDLLMGNECAVCLDEIGTEQPVRVVPGCNHAFHLECADTWLSKHPLCPLCRAKLDPSLFSSSQNPC

SEQ ID NO: 577 - protein, 163 aa, Arabidopsis thaliana
  misc_feature (1)..(163): Ceres CLONE ID no. 4267
  misc_feature (1)..(163): Functional Homolog of  Ceres CLONE ID no. 560731 at SEQ ID NO. 576 with e-value of 2.49E-31 and percent identity of 50.7
MHYTRISPALVPSLSPTAAAESSDGGTMIATVFMALLLPCVGMCIVFLIYLFLLWCSTRRRIERLRFAEPVKPVAGKGLSVLELEKIPKLTGRELAVIARSTECAVCLEDIESGQSTRLVPGCNHGFHQLCADTWLSNHTVCPVCRAELAPNLPQCNENQSPC

SEQ ID NO: 578 - protein, 165 aa, Zea mays
  misc_feature (1)..(165): Ceres CLONE ID no. 1377336
  misc_feature (1)..(165): Functional Homolog of  Ceres CLONE ID no. 560731 at SEQ ID NO. 576 with e-value of 6.20E-28 and percent identity of 47.6
MHYTRISPIILPSPPPTITATVESSGRGTMLATLFMALLLPCVGMCIVFLIYLFFLWCSTRRRIERLRFSEPVKLVTGKGLSVSELEKLPKLTGKELALEVRSTECPVCLENIESCQSARLVPGCNHGFHQLCADTWLSNHTVCPVCRGDLAQKVPQLSNNHSPC

SEQ ID NO: 579 - DNA, 1247 bp, Arabidopsis thaliana
  misc_feature (1)..(1247): Ceres CLONE ID no. 6066
  misc_feature (1)..(1247): Also Known As Ceres CDNA ID no. 23366207
  misc_feature (1)..(1247): Also Known As Ceres GEMINI ID no. 555A11
ctctttaggattctcctctgggctctggtaaggtattagaaagatcaaaactttttggattccctgaaattgggtgaaagatgggtaacgctcttacgtttctctacggaaaatgctgcaaacccacaacaaccgatgactctcttggtcctcacggcgtctccgccgccaccgtcggtgtttcagctctcgctcacgatctcttcaacttcgagatcacttcccaggttcctgaagggcttgggaggtatgttcagtcatctagaaaagctcaagcaaactggtatagaaaaatacttgaggcatggaagcaagcaaaacctccaccgcagacagctgaggaagcttctaggcttgtcactgatatcttaaaaaggaatcagaaagctgatgttgaggggcttttgtctttctatggactccctttgtctcatactctagttgaagtcactgttgaagctcctgtgtctttgcctgaagggattcttttcgaatttcaaacacttccggtggatccaaaagctgtggcagatggagacaccatcacagtgtatgtcagtacttcagagccggttgtgtcatcttctgttccaagggaagtcaatcttgcagctgttcaaagagcaaaagcacgtgagaagagaaattatccaaaagcagacgaacttcaccaaaagatcattgattctggttacagggtactaaatattgagaatgaggaagttcttgctcggaagttcagaattagactaaggggaatagatgcaccagagagccaaatgccgtttgggaaagaggcacaagaagggctcttaaagattgttgggcggaaaagcttgaaggtgttagtttatggagaagatcaatatgggcgatgcgtaggtgatttatactgcaatgggatctttgtccaggaggcaatgttaaagaaagggcttgcttggcattacttagcttatgacaagcgcccggttctcgcaaagtgggaaaaggaggcaaggcagaagcgtattggcttgtgggcttcttcaaatccagagaagccatgggactggagaaagaataataggcgggaatagtcaaccgactttgtttgggcaaaatcacaaaccaagtaatcagcgtttaaaacaattgagatttgtgattgttgagggtttttgtttaaatcctcagccctattctgtgtgtaaatggtttgtgcactcaccctatctttgatgagacatatcgagatattatagagc

SEQ ID NO: 580 - protein, 332 aa, Arabidopsis thaliana
  misc_feature (1)..(332): Ceres CLONE ID no. 6066
  misc_feature (1)..(332): Also Known As Ceres CDNA ID no. 23366207
  misc_feature (1)..(332): Also Known As Ceres GEMINI ID no. 555A11
  misc_feature (198)..(316): Pfam Name: SNase Pfam Description: Staphylococcal nuclease homologue
MGNALTFLYGKCCKPTTTDDSLGPHGVSAATVGVSALAHDLFNFEITSQVPEGLGRYVQSSRKAQANWYRKILEAWKQAKPPPQTAEEASRLVTDILKRNQKADVEGLLSFYGLPLSHTLVEVTVEAPVSLPEGILFEFQTLPVDPKAVADGDTITVYVSTSEPVVSSSVPREVNLAAVQRAKAREKRNYPKADELHQKIIDSGYRVLNIENEEVLARKFRIRLRGIDAPESQMPFGKEAQEGLLKIVGRKSLKVLVYGEDQYGRCVGDLYCNGIFVQEAMLKKGLAWHYLAYDKRPVLAKWEKEARQKRIGLWASSNPEKPWDWRKNNRRE

SEQ ID NO: 581 - protein, 288 aa, Arabidopsis thaliana
  misc_feature (1)..(288): Public GI No. 4586057
  misc_feature (1)..(288): Functional Homolog of  Ceres CLONE ID no. 6066 at SEQ ID NO. 580 with e-value of 0.0 and percent identity of 97.8
MGNALTFLYGKCCKPTTTDDSLGPHGVSAATVGVSALAHDLFNFEITSQVPEGLGRYVQSSRKAQANWYRKILEAWKQAKPPPQTAEEASRLVTDILKRNQKADVEGLLSFYGLPLSHTLVEVTVEAPVSLPEGILFEFQTLPVDPKAVADGDTITVYVSTSEPVVSSSLFGDGKGNRGIDAPESQMPFGKEAQEGLLKIVGRKSLKVLVYGEDQYGRCVGDLYCNGIFVQEAMLKKGLAWHYLAYDKRPVLAKARLWEKEARQKRIGLWASSNPEKPWDWRKNNRRE

SEQ ID NO: 582 - protein, 335 aa, Glycine max
  misc_feature (1)..(335): Ceres CLONE ID no. 467480
  misc_feature (1)..(335): Functional Homolog of  Ceres CLONE ID no. 6066 at SEQ ID NO. 580 with e-value of 1.79E-125 and percent identity of 70.3
  misc_feature (274)..(274): Xaa is any aa, unknown, or other
  misc_feature (275)..(275): Xaa is any aa, unknown, or other
MGNALRFLYSHCCKPTAAGDSESLGPHGVSSATVGVSTLAHDLFHFDITSQVPEGLSKHVVSSKKAQANWYRKLVDAWKEAKPPPKTPEEAARLVIQTLRRHQKADVEGLLAFYGLPLPHTLVQGTTQPLSSLPDGVQFEMHTLPVDAKAVADGDTITVYVSTTDPRESAFVPGNVHAAAVRRSEARARRNFTEADALHKQIIDSGYRVIPVQNEEILAKKYRIRLRGIDAPESAMPYGKEAKTELTKIVQGKPLRILVYEEDRYGRSVGDIYXXGIFVQEMMLKKGLAWHYVAYDKRPELETWEKQARAKRVGLWASKNPEKPWEWRKDRREAA

SEQ ID NO: 583 - protein, 338 aa, Corydalis sempervirens
  misc_feature (1)..(338): Public GI No. 18258
  misc_feature (1)..(338): Functional Homolog of  Ceres CLONE ID no. 6066 at SEQ ID NO. 580 with e-value of 1.59E-117 and percent identity of 66.9
MGNALRFLYGHCCKPTVEDHYQPPHGYGVSTATVGVSALAHDLFHFENTSQIPEGLTKYVVSSKKAQTNWYKKLSQAWREAKPPPQTAEQATRLIILTLKRHQKADVKGLLRFYGLPLSNNPSTEATTVVAPPQADQGVKFELHTLPVDVKAVADGDTVTVYVNTEDPREASNLPKSVKVAAQERAKARAVRDYVKADALQKNIVDAGYRVLSGPNNEDILARKYRIRLRGIDSPESSMPFGKEAKEELIKLVVGKCLTVHIYEEDRYGRSVGDIYCNGQFIQEKMLKKGLAWHYTAYDKRPQLSKWEEKARAARVGLWASSNPEKPWEWRKNKRNGK

SEQ ID NO: 584 - DNA, 1484 bp, Arabidopsis thaliana
  misc_feature (1)..(1484): Ceres CLONE ID no. 6163
  misc_feature (1)..(1484): Also Known As Ceres GEMINI ID no. 553B10
ataccacattagaaacttcccactctcgctctcgtttgcttcttcttcatcgtttcacccactcacttcattctctctctaaaaccttcactttctctatctatcttcaaaacaatgggaaacctgtttgacagtagcaagactttatggggaaacatgaaccatggatcgtcacgttactctctaaacggcaaaatcatgcttgcttccgtcatcatcctcttcgtcgccgtcattttaatcctctgtttccacagctacgctagatggttattccgccgtcaaaaccgccgtattcgccgccgtatcagtgctcacctccgatcactcgccgccgctagagaccccacccaatcatcatcctccctctctcctcttgatccgacggtgctcgagaagatccctatcttcgtctactccgttaaaacccatgaatctccgcttgaggaatgctctgtttgcttgtcggaattcgaagaagacgacgaaggacgtgtccttcccaaatgcggccacgtgttccatgtcgattgtatagacacgtggttccggtccagatcaagttgtcctctttgtagagctccggttcaacccgcacagccggttaccgaacccgaaccggttgctgctgtgtttccatcggttaaaccaattgaggataccgaagccggaagttcctcttcatcggacgaatccgaatcctcgacgccgtcttcctcctctggttcgccggtgaggtttccgatggaagcttgtgagagagaaccgattgatttagtcggtatcattgtggagattcccagggaatttcaagattctaattcggatctacccgcagataacgggtcgaatcgtcgggcttcgttgaaaaggctatggattatttgatcacataattggatagtgactgaatccgacccggtaaatgggtgggcataataattcggattctgaagatccggtaatatgacgcagcgggcagaatcgtattactggcatggaagacgacacgtggcgtttttggggatccacatggcaatcactgggacgtttgctttacaaaaagacaccgtttgggaaaaatgaacggaagtgatatctaaagtaacggagccgtttgatgacaatgtttatataccagacggcgtcgttcagtggagagtggagcaaatcgctaagcgaagctctcccaccaaaacgattttctttgttttttttccttcttcttctcttaaaatttaattaaaataagtgaatgtaatttgatcaagattttatcttacttctgtaattaaaattaaaatattattcattattattaatttaaccgaatgttagccttaaatgctagtgtatcgatttgtaaagtttaatccatctactagttttggtcaaatgttgtttcaaattgtaaaactctcagggcatgcatgtatattgtataatcgtattatgagaaaatggatacacaatgcaaatccttt

SEQ ID NO: 585 - protein, 257 aa, Arabidopsis thaliana
  misc_feature (1)..(257): Ceres CLONE ID no. 6163
  misc_feature (1)..(257): Also Known As Ceres GEMINI ID no. 553B10
  misc_feature (113)..(154): Pfam Name: zf-C3HC4 Pfam Description: Zinc finger, C3HC4 type (RING finger)
MGNLFDSSKTLWGNMNHGSSRYSLNGKIMLASVIILFVAVILILCFHSYARWLFRRQNRRIRRRISAHLRSLAAARDPTQSSSSLSPLDPTVLEKIPIFVYSVKTHESPLEECSVCLSEFEEDDEGRVLPKCGHVFHVDCIDTWFRSRSSCPLCRAPVQPAQPVTEPEPVAAVFPSVKPIEDTEAGSSSSSDESESSTPSSSSGSPVRFPMEACEREPIDLVGIIVEIPREFQDSNSDLPADNGSNRRASLKRLWII

SEQ ID NO: 586 - DNA, 725 bp, Glycine max
  misc_feature (1)..(725): Ceres CLONE ID no. 625627
  misc_feature (1)..(725): Also Known As Ceres GEMINI ID no. 531A1
aatataaccacctcacatttttttcatcactccttaaagatgacaacagcagaaaaaacttcaaacttggatctcatacgccaacacctctttggtgaaaacatcatctcagactcctcctcctttgtctccaatctccatcatcatcctgtgaaacttgaacccccctcatcaccagaatttgatttcacctcatatatcttagataacaacacaagcagcaacttcttcacattccttgaaggctatgatttggtggcagacatgaagtttgtaattgattcagacaacaccaccaccatggtgatcccttcaaaggaggttataaagaaatgcaatattaattctcctgaagaacaaccaatggtgtcatcatcatcagaagagaagccaacaatgaaaaagtcagaacattatgatgaggcaaagcgttataggggagttaggagaaggccatgggggaaatttgctgctgaaatccgtgaccctacaaggaaagggacaagggttactagaagatcttcgtcgtccaatgcttccttgcccgcaagcccattgcgataattagttacagcattggaaaagaataagcaatgttctcgattgcacttcattccctttcaaaagaaggcaatttgggggcaagcttcttttttgttcatagccgaattagtcacaacatttattcattggatgcaacattgggactcttggaaagtgttggc

SEQ ID NO: 587 - protein, 174 aa, Glycine max
  misc_feature (1)..(174): Ceres CLONE ID no. 625627
  misc_feature (1)..(174): Also Known As Ceres GEMINI ID no. 531A1
  misc_feature (130)..(174): Pfam Name: AP2 Pfam Description: AP2 domain
MTTAEKTSNLDLIRQHLFGENIISDSSSFVSNLHHHPVKLEPPSSPEFDFTSYILDNNTSSNFFTFLEGYDLVADMKFVIDSDNTTTMVIPSKEVIKKCNINSPEEQPMVSSSSEEKPTMKKSEHYDEAKRYRGVRRRPWGKFAAEIRDPTRKGTRVTRRSSSSNASLPASPLR

SEQ ID NO: 588 - DNA, 1391 bp, Arabidopsis thaliana
  misc_feature (1)..(1391): Ceres CLONE ID no. 6568
  misc_feature (1)..(1391): Also Known As Ceres GEMINI ID no. 531F3
gaaaaagagagcgagcgatgaacagtatcttctccattgacgatttctccgatcctttctgggaaactcctccgattcctctcaatcctgactcttctaagcctgttacggcggatgaagttagccagagtcaaccggaatggactttcgagatgtttctcgaagagatttcttcgtcggcggtgagctctgagccacttggtaacaacaacaacgcgatcgtcggtgtttcttcggcgcaatctcttccttctgtttccggacagaatgatttcgaggatgatagtcgatttcgtgatcgcgattcgggaaatttggattgtgctgctcccatgacgacgaagacggtgattgttgattccgatgattatcgtcgtgttcttaagaacaagcttgagactgagtgcgctactgttgtttctcttcgggttgggtctgtgaagcctgaagattcgactagttctccagaaactcaacttcaaccagttcaatccagtcctcttactcaaggagaacttggtgttacttcttccttaccagctgaggtgaaaaaaactggtgtatcaatgaagcaggttactagtggatcgtcgagagaatattctgatgacgaggaccttgatgaagagaatgaaaccaccggttccttgaagccagaggacgttaaaaaatctagaaggatgctgtcaaatcgtgagtcagctaggcgatctagaaggagaaagcaggagcaaacaagtgacctcgaaacacaggttaatgatctaaaaggtgagcattcatcacttcttaaacaactgagcaacatgaatcacaagtatgacgaggctgctgttggcaatagaatactaaaggctgacattgagacattaagagctaaggtgaaaatggcggaagaaaccgtgaagagagtaacaggaatgaatccgatgcttctcggaagatcaagtggacataacaacaacaacagaatgccaataactggtaacaacaggatggattcttctagcattattccagcttatcaaccacactcaaacctaaaccacatgtcaaaccaaaacatcgggatcccaaccattctacctccaagactcggaaacaatttcgctgctcctccatcccaaaccagctctcccttgcagagaattagaaatgggcaaaatcaccatgttactccaagcgccaacccgtatggctggaataccgaacctcagaacgattcagcatggccgaaaaaatgcgtggactgatcaaacaagaagcgggtttcgcactatattaatgtctatgcatctgtaatttgtaagtgttattaagttacgaatcatgagaaaacatcttgtgaaaatacagtctcatggcttatatatatataagctctgtcttat

SEQ ID NO: 589 - protein, 411 aa, Arabidopsis thaliana
  misc_feature (1)..(411): Ceres CLONE ID no. 6568
  misc_feature (1)..(411): Also Known As Ceres GEMINI ID no. 531F3
  misc_feature (213)..(277): Pfam Name: bZIP_1 Pfam Description: bZIP transcription factor
  misc_feature (278)..(295): Pfam Name: bZIP_2 Pfam Description: Basic region leucine zipper
MNSIFSIDDFSDPFWETPPIPLNPDSSKPVTADEVSQSQPEWTFEMFLEEISSSAVSSEPLGNNNNAIVGVSSAQSLPSVSGQNDFEDDSRFRDRDSGNLDCAAPMTTKTVIVDSDDYRRVLKNKLETECATVVSLRVGSVKPEDSTSSPETQLQPVQSSPLTQGELGVTSSLPAEVKKTGVSMKQVTSGSSREYSDDEDLDEENETTGSLKPEDVKKSRRMLSNRESARRSRRRKQEQTSDLETQVNDLKGEHSSLLKQLSNMNHKYDEAAVGNRILKADIETLRAKVKMAEETVKRVTGMNPMLLGRSSGHNNNNRMPITGNNRMDSSSIIPAYQPHSNLNHMSNQNIGIPTILPPRLGNNFAAPPSQTSSPLQRIRNGQNHHVTPSANPYGWNTEPQNDSAWPKKCVD

SEQ ID NO: 590 - protein, 391 aa, Hordeum vulgare subsp. vulgare
  misc_feature (1)..(391): Public GI No. 1869928
  misc_feature (1)..(391): Functional Homolog of  Ceres CLONE ID no. 6568 at SEQ ID NO. 589 with e-value of 3.59E-40 and percent identity of 42.1
MERVFSVEEIPDPFWGQPSPRQRGRRPPEGAMNRCPSEWYFQKFLEEAVLDSPAADPSPMSGASGRGQAACRPRGVAGTATGPAVDPVEYNAMLKQKLEKDLAAVAMWRASGAMPPERFAASPSCPNADGQHIGTINPIGGNVVPLQNKLAGGASGVSGPHLVQNADALVKQAASSSSREQSEDDDMEGEDEITGNGVPTDQRLRRRKQSNRESARRSRSRKAAHLNELEAQVSQLRVENSSLLRRLADVNQKYNGAAVDNRVLKADVETLRAKVKMAEDSVKRVTGMSALFPAGSDMSSLSMPFTGSPSEATSDAAFPDDLSAYFSTSEAGGNNGYMPEMASSAQEDDNFLNETMDTSKMGRPDSLHRVASLEHLQKRMCGGPASSGSTS

SEQ ID NO: 591 - protein, 425 aa, Oryza sativa
  misc_feature (1)..(425): Public GI No. 7489532
  misc_feature (1)..(425): Functional Homolog of  Ceres CLONE ID no. 6568 at SEQ ID NO. 589 with e-value of 1.00E-42 and percent identity of 41.4
MERVFSVEEISDPFWVPPPPPQSAAAAQQQGGGGVASGGGGGVAGGGGGGNAMNRCPSEWYFQKFLEEAVLDSPVPNPSPRAEAGGIRGAGGVVPVDVKQPQLSAAAAAAATTSAVVDPVEYNAMLKQKLEKDLAAVAMWRASGTVPPERPGAGSSLLNADVSHIGAPISIGGNATPVQNMLSGPSGGSGSQLVQNVDVLVKQATSSSSREQSDDDDMEGEAETTGTARPADQRLQRRKQSNRESARRSRSRKAAHLNELEAQVSQLRVENSSLLRRLADVNQKYNDAAVDNRVLKADVETLRAKVKMAEDSVKRVTGMNALFPAASDMSSLSMPFNSSPSEATSDAAVPIQDDPNNYFATNNDIGGNNNYMPDIPSSAQEDEDFVNGALAAGKIGRTASLQRVASLEHLQKRMCGGPASSGSTS

SEQ ID NO: 592 - DNA, 1338 bp, Glycine max
  misc_feature (1)..(1338): Ceres CLONE ID no. 660003
  misc_feature (1)..(1338): Also Known As Ceres CDNA ID no. 23704291
  misc_feature (1)..(1338): Also Known As Ceres GEMINI ID no. 553H5
gtcataactttgctagatccatcaaagaagcagtgattcccccagcttccacatcaaatgaagccataatcatcatcatcatcaccacgcctcttctttctctttctccctaccattcacaatgtcatcgatacaccactactcaccggaaacaacactatactggaccagcgaccaccagcaacaacaacaacaacaacaacaacaacaacaacaagctgccacgtggcttagtaattcccacactccccgtttcaacctgaacgaagacgacgacgaggaagacgacgttgtcgtttcggacaaggctactaataatttggcgcaagaacaggagaaagaagcgatgttcgagaagccgttgacgccgagcgacgtcgggaagctgaaccggctcgtgatcccgaaacagcacgcggagaagtacttccctcttgactcgtccggcggtgactcggcggcggcgaaagggctcttgctgagtttcgaggacgagtcggggaagtgctggcgcttccgttactcttattggaacagtagccagagttacgttttgaccaaaggctggagccgttacgtcaaagacaaacgcctccacgcaggcgacgtcgttttgttccacagacaccgcgcccaccctcaacgcttcttcatctcctgcacccgccaccaacccaaccccaaccctcccgcgcacgttagcatcagatcctcctcctactctgcgctcccagcttatcctacgcaccatcatcatcacctccccttcccataccaacctcactctcttcacgcaccaggtggagggtcccaaggacagaacgaaacgacaccaggagggaacagttcaagtggcagggtgctgaggctgtttggggtgaacatggaatgccaacctgataatgataatgattcccaaaactccacacatgaatgctcctacacccacttataccaccatcaaacctcttcttatccttcttcaaaccctcaccatcacatgctacctcaacaaccataatagaaattagatatatatgcccccctctttattagattctcccccgttttttttttttcatttccagcttcagggttgaagtatgcccttaaattaattttagtcaatgaccgtgtcgttaacatgaacccgtgaaaggaacccttcttttattattagtatatttaggttgacgttgaagattatagaggatctttcttgtcttgaattagggagatgcatgcaaatggaaatgccttgtttattcgttttatcggatcttcttgttccctgtcactcgagcatattaattatcgactaagctgtgaatgcatgcc

SEQ ID NO: 593 - protein, 299 aa, Glycine max
  misc_feature (1)..(299): Ceres CLONE ID no. 660003
  misc_feature (1)..(299): Also Known As Ceres CDNA ID no. 23704291
  misc_feature (1)..(299): Also Known As Ceres GEMINI ID no. 553H5
  misc_feature (76)..(181): Pfam Name: B3 Pfam Description: B3 DNA binding domain
MSSIHHYSPETTLYWTSDHQQQQQQQQQQQQQAATWLSNSHTPRFNLNEDDDEEDDVVVSDKATNNLAQEQEKEAMFEKPLTPSDVGKLNRLVIPKQHAEKYFPLDSSGGDSAAAKGLLLSFEDESGKCWRFRYSYWNSSQSYVLTKGWSRYVKDKRLHAGDVVLFHRHRAHPQRFFISCTRHQPNPNPPAHVSIRSSSYSALPAYPTHHHHHLPFPYQPHSLHAPGGGSQGQNETTPGGNSSSGRVLRLFGVNMECQPDNDNDSQNSTHECSYTHLYHHQTSSYPSSNPHHHMLPQQP

SEQ ID NO: 594 - DNA, 1627 bp, Glycine max
  misc_feature (1)..(1627): Ceres CLONE ID no. 674157
  misc_feature (1)..(1627): Also Known As Ceres CDNA ID no. 23704869
  misc_feature (1)..(1627): Also Known As Ceres GEMINI ID no. 555C4
gtataggagtactgttactggtcgataggaaagaaaatatggaatgtcctggccccggtattgtactattttcattttgaccaatatgccccgggcctctccttttgtgtagctgcgtgcctccctccatccccatcgcatcacacagaatcaaaggaaaggagacgtacgatacgatacgatacgatatggatagggtattctcagtggacaatatctccgatcatttctggccgccgcctccgatccccgtctccggcgccaacacctcctctcagatgagccgcagcgcctccgagtgggcctttcagcgcttcatccaggaagcttccgcctccgcaccctctcctccgtcttcttcctcccccgccgacgtcgtattcgtggagatcgatgatcagcccaaacccacccctccgcctccgtcacacggcggcgttctgcccagtgaccctggtcccgtggcccttgactccgaggaataccaggcctttctcaagagcaagctcaacctcgcatgcgccgccgtcgccatgactaggggatctttggctaaatctcaagacccgtcccctttttctgatggtggatcacagccgactaatccttctctagttggatctcagactacttctaaaggatctattccttctggaaatgatcaatctaagttacaagataaagatatcaatgcaccagttgggattccttccatacctgccatacaaaagaaacctgctgttgcaattaggccatctacaagtggatcatcaagagaacagtcagatgatgaggacattgagggagagacatctatgaatgacaacacagaccctgctgatgtaaaacgagtaaggaggatgctatccaatagggagtcagcccgtcgctctagaagaagaaagcaggctcatttaactgacctagaaacacaggtttctcaattaagaggtgaaaattctaccttgttaaagcgccttactgatgttagtcagaaatacagcgactctgctgttgacaacagagttttaaaagctgatgttgaaacattaagagcaaaggtgaagatggctgaagagaccgtcaaaagaattactgggttgaacccaatgcctcatgccatgtctgatatatcatcattgggcctgccatcatttgatggaagaagcccttcagacacttcagctgatgcatctgttcctgtgcaagatgatccacatcatcacttctatcaacccacattgaataatcctattcccagtcatgatccgatagtcaacaatggtttggggggcatttcttcaattgaaaatgtgcagcagcagaacgctgcagcagtggtaggtgggaacaagataggtcaaacagcatccctgcagcgggtggctagcttggaacatcttcagaagcggattcgtggtggacctccatctgagcagtaactaagtagccagatcttaaggttgctttgccaaaaaattattctaaaacagttatttctgttgcctattcttctggaatacattgtaaatcatttgatggagcacatgatgctggattcaattagtgcaccccgtttttttttttttttttttataaaaataatataaaatgaacctttaccttc

SEQ ID NO: 595 - protein, 417 aa, Glycine max
  misc_feature (1)..(417): Ceres CLONE ID no. 674157
  misc_feature (1)..(417): Also Known As Ceres CDNA ID no. 23704869
  misc_feature (1)..(417): Also Known As Ceres GEMINI ID no. 555C4
  misc_feature (216)..(270): Pfam Name: bZIP_2 Pfam Description: Basic region leucine zipper
MDRVFSVDNISDHFWPPPPIPVSGANTSSQMSRSASEWAFQRFIQEASASAPSPPSSSSPADVVFVEIDDQPKPTPPPPSHGGVLPSDPGPVALDSEEYQAFLKSKLNLACAAVAMTRGSLAKSQDPSPFSDGGSQPTNPSLVGSQTTSKGSIPSGNDQSKLQDKDINAPVGIPSIPAIQKKPAVAIRPSTSGSSREQSDDEDIEGETSMNDNTDPADVKRVRRMLSNRESARRSRRRKQAHLTDLETQVSQLRGENSTLLKRLTDVSQKYSDSAVDNRVLKADVETLRAKVKMAEETVKRITGLNPMPHAMSDISSLGLPSFDGRSPSDTSADASVPVQDDPHHHFYQPTLNNPIPSHDPIVNNGLGGISSIENVQQQNAAAVVGGNKIGQTASLQRVASLEHLQKRIRGGPPSEQ

SEQ ID NO: 596 - DNA, 1681 bp, Glycine max
  misc_feature (1)..(1681): Ceres CLONE ID no. 691319
  misc_feature (1)..(1681): Also Known As Ceres GEMINI ID no. 553H6
aaaagggtgtccaaagaaggaatcacacaagagaaattttgggtggatcttggtaatttaaatttggtccaaaaatagtaagaaaaaaaaaccatagttcatttaattttcatgtccttgctaacggtggcgcaccaaagggggtcaggtgagtttatccggttcacggaaagtcatggcggtggtggcgatgacgtcagtggtgacggtgaacatggttgtggacatgatgatggaagtggtgctggaggttcactagggttgaattttaaccaagtgatgcaacaaggtgaggtgacaatgcaaggtggttcattggtttcagggtataacaggggtgatccagagttgagagaaatagtttcagctttgacacacgtggtgtcttcagggtctggccagaggagcaccgaattgacccagcaaagtggttttcctatgatgtctgcttcttctctttcacgtttgtctgctttctcttcttcttctccttctccttcttctggagcctcttgggttggccacaaaagaggcagagaagaagaagagaatagtacttcacataacttgatgcaacaacaacaacaaagtgctccaagactcttcagaaacattggtgacttcatggtgccttctcaaggagactcatcatcagtgacagaagaagcccccacctccacaactacaactgtaaccgccgtcactgaaaacccaccaggaggtggggaaaggaggagaaagtacagaggagtgaggcagaggccatggggaaaatgggcagcagaaatccgtgatccacacaaagcagcaagagtttggctaggcacatttgacacagaagaagcagcagcaagagcctatgatgaagctgcattgaggttcagaggcaacagagcaaagcttaacttccctgaaaatgtaagagcagttccacccattcaaccttttcaagccaccactaggctaaccgtttctgattccaccacctctcaattccggccactctccgcggtggcgccacccttcattcagcagccacagattcagggctcctctgacttgatcagagactacttgcaatactctcagcttctacagagtgattttcaacagcaacaaatacaacaacaacagcagcagcagcggcagcagcagcagcggcagcggcagcagcggcagcagcagcagcaacaacaacaacaaccatctagtttgcttcagcagttgtactataatgcacaatttgcttcacttcaatcaccttcaatgctatcatcatctccttcattttcttcttctgtgtctccagcaccattcccattattcacaacctctgcttctttccccttgttttcaagtcaacaaatgggctatttccagccaccggaaagccgcaatcccgctggcggcgtgccggagtttccaacgtccacatggtcggataccagtagccagccaccaccttctggttgatacagtgttttagtttccttcatattttcctttttcttttttctttctttcattcttagcataaaaaaaaaagacttgttatacttatttcttttttcaagggtgaaactatgatatagttttttttaagtatttttggtactattctcgtatcagaattagagtttcagtaatttatgttgatattcaatacaaatctttattatgt

SEQ ID NO: 597 - protein, 453 aa, Glycine max
  misc_feature (1)..(453): Ceres CLONE ID no. 691319
  misc_feature (1)..(453): Also Known As Ceres GEMINI ID no. 553H6
  misc_feature (209)..(272): Pfam Name: AP2 Pfam Description: AP2 domain
MSLLTVAHQRGSGEFIRFTESHGGGGDDVSGDGEHGCGHDDGSGAGGSLGLNFNQVMQQGEVTMQGGSLVSGYNRGDPELREIVSALTHVVSSGSGQRSTELTQQSGFPMMSASSLSRLSAFSSSSPSPSSGASWVGHKRGREEEENSTSHNLMQQQQQSAPRLFRNIGDFMVPSQGDSSSVTEEAPTSTTTTVTAVTENPPGGGERRRKYRGVRQRPWGKWAAEIRDPHKAARVWLGTFDTEEAAARAYDEAALRFRGNRAKLNFPENVRAVPPIQPFQATTRLTVSDSTTSQFRPLSAVAPPFIQQPQIQGSSDLIRDYLQYSQLLQSDFQQQQIQQQQQQQRQQQQRQRQQRQQQQQQQQQPSSLLQQLYYNAQFASLQSPSMLSSSPSFSSSVSPAPFPLFTTSASFPLFSSQQMGYFQPPESRNPAGGVPEFPTSTWSDTSSQPPPSG

SEQ ID NO: 598 - DNA, 656 bp, Arabidopsis thaliana
  misc_feature (1)..(656): Ceres CLONE ID no. 7201
  misc_feature (1)..(656): Also Known As Ceres CDNA ID no. 23383956
  misc_feature (1)..(656): Also Known As Ceres GEMINI ID no. 532G1
attttttctttctctctctcctccctaagcaaaactaaaacaagctatggctggtatgcttcccggagttgagtgtgcaaggaggcggcgcttccacggtggtgctcctccgattgaatcctcgaacacagcttctgtggcggctgcggcgggacacgtctggacacggcgaccatcgttctctctttacactaccaatcatgagagccaccaggcccatgtctccttctcggagagaagtgttaggaataaatcttatggagaagacaacgatgagaaacttgacggagcagccaaagaggcaaagcagaggcttaacaagcggctgagaatcccaccacgtacaaggcaaaatggtaaagacaaagggaataaattggagcaaggaaagggtaaacctctcggggacttaccgaccgaggtggtcgggttaaagaagagccgaggaaggttgatggaatggttcaagcggcgagttagggaacaacaagattgtgctatatgtctagaccggttcaagaagggtgagaccttggtacacctaccatgtgcccataagtttcactccatatgcttattgccttggctagacactaatgtttattgcccatattgtagaactgatatttggaattaaatgttatatttttgatgcc

SEQ ID NO: 599 - protein, 196 aa, Arabidopsis thaliana
  misc_feature (1)..(196): Ceres CLONE ID no. 7201
  misc_feature (1)..(196): Also Known As Ceres CDNA ID no. 23383956
  misc_feature (1)..(196): Also Known As Ceres GEMINI ID no. 532G1
  misc_feature (150)..(190): Pfam Name: zf-C3HC4 Pfam Description: Zinc finger, C3HC4 type (RING finger)
MAGMLPGVECARRRRFHGGAPPIESSNTASVAAAAGHVWTRRPSFSLYTTNHESHQAHVSFSERSVRNKSYGEDNDEKLDGAAKEAKQRLNKRLRIPPRTRQNGKDKGNKLEQGKGKPLGDLPTEVVGLKKSRGRLMEWFKRRVREQQDCAICLDRFKKGETLVHLPCAHKFHSICLLPWLDTNVYCPYCRTDIWN

SEQ ID NO: 600 - protein, 198 aa, Arabidopsis thaliana
  misc_feature (1)..(198): Ceres CLONE ID no. 40916
  misc_feature (1)..(198): Functional Homolog of  Ceres CLONE ID no. 7201 at SEQ ID NO. 599 with e-value of 3.79E-91 and percent identity of 88.8
MAGMLPGVECARRRRFHGGAPPIESSNTASVAAAAGHVWTRRPSFSLYTTNHESHQAHVSFSERSVRNKSYGEDNDEKLDGAAKEAKQRLNKRLRIPPRTSSGKMVKTKGINWSKERVNLSGTYRPRWVGLKKSRGRLMEWFKRRVREQQDCAICLDRFKKGETLVHLPCAHKFHSICLLPWLDTNVYCPYCRTDIWN

SEQ ID NO: 601 - protein, 215 aa, Triticum aestivum
  misc_feature (1)..(215): Ceres CLONE ID no. 879445
  misc_feature (1)..(215): Functional Homolog of  Ceres CLONE ID no. 7201 at SEQ ID NO. 599 with e-value of 9.50E-24 and percent identity of 45.0
MAGMLPGVECARRRRMWQGGGAGADQAAAGTRRLSFCLYAAGHGAAHAVGTGNSGNKQRSGAMDGWALDSNAREAKERLDQKLKSKSTGPDTVIKRHHSTGSIKLSRANGSGGGGGGGGGSSAAVATGVQREVYSKKGVMRRLMRWSRLRWEAAEQAECAVCLEEFAAGDVLAHLPCGHRFHWGCALPWLEGAAAASHSCPFCRAAVDAGAHAAS

SEQ ID NO: 602 - protein, 211 aa, Zea mays
  misc_feature (1)..(211): Ceres CLONE ID no. 294406
  misc_feature (1)..(211): Functional Homolog of  Ceres CLONE ID no. 7201 at SEQ ID NO. 599 with e-value of 2.00E-23 and percent identity of 44.4
  misc_feature (65)..(65): Xaa is any aa, unknown, or other
MVLMAGMLPGVECARRRRVRQGGAGMGAEAAGGGTGRRSSFCLYAAGHGGAGNSGKRSGGVVHGXGWTLDSNAREAKERLDQKLRTKREAAIKRHHSTGSIKLGVPHRSAGADERGESSAPAMAGVQREVYSKKGVMRRLMRWSRPRWAAAEQAECAVCLDEFRAGDVLAHLRCGHRFHWACALPWLEGTSRCPFCRAAVDAGAGAGADGA

SEQ ID NO: 603 - DNA, 768 bp, Arabidopsis thaliana
  misc_feature (1)..(768): Ceres CLONE ID no. 7805
  misc_feature (1)..(768): Also Known As Ceres CDNA ID no. 23366147
  misc_feature (1)..(768): Also Known As Ceres GEMINI ID no. 531D8
aataaacaccagtcgcagcgtttcgtagaaaaattcgatttctctaaagccctaaaactaaaacgactatccccaattccaagttctagggtttccatcttccccaatctagtataaaatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatactgttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggcgataataagggatcaggaaagagtggagatggatcaaatcgagatgctggtggcggtgtttctggtgaagaaatgccgagctggtaaaagaagttgcaagtagtgattaagaacaatcgccaaatgatcaagggaaattagagatcagtgagttgtttatagttgagctgatcgacaactatttcgggtttactctcaatttcggttatgttagtttgaacgtttggtttattgtttccggtttagttggttgtatttaaagatttctctgttagatgttgagaacacttgaatgaaggaaaaatttgtcc

SEQ ID NO: 604 - protein, 141 aa, Arabidopsis thaliana
  misc_feature (1)..(141): Ceres CLONE ID no. 7805
  misc_feature (1)..(141): Also Known As Ceres CDNA ID no. 23366147
  misc_feature (1)..(141): Also Known As Ceres GEMINI ID no. 531D8
  misc_feature (24)..(89): Pfam Name: CBFD_NFYB_HMF Pfam Description: Histone-like transcription factor (CBF/NF-Y) and archaeal histone
MADTPSSPAGDGGESGGSVREQDRYLPIANISRIMKKALPPNGKIGKDAKDTVQECVSEFISFITSEASDKCQKEKRKTVNGDDLLWAMATLGFEDYLEPLKIYLARYRELEGDNKGSGKSGDGSNRDAGGGVSGEEMPSW

SEQ ID NO: 605 - protein, 132 aa, Glycine max
  misc_feature (1)..(132): Ceres CLONE ID no. 1045975
  misc_feature (1)..(132): Functional Homolog of  Ceres CLONE ID no. 7805 at SEQ ID NO. 604 with e-value of 5.60E-51 and percent identity of 84.0
MSDAPPSPTHESGGEQSPRGSSSGAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSA

SEQ ID NO: 606 - DNA, 830 bp, Arabidopsis thaliana
  misc_feature (1)..(830): Ceres CLONE ID no. 8788
  misc_feature (1)..(830): Also Known As Ceres CDNA ID no. 23370421
  misc_feature (1)..(830): Also Known As Ceres GEMINI ID no. 555D2
aaaaaccaaaactcttatcttcggtacagagcaaatcacagctcccgatggccgccacgtcatcatcaccgccgtgtaacatctccgcgtcctccctcctcctccgtcaaccttctcgctcaatccttaaagtgttcggtttattaccacctgtaagtaggaataaccgtaaactcggccggttaacggtgacccggtctaatctggcgcaggattttcttggtgacttcggagctcgtgacccttacccggaggagatagcgagtcaattcggagataaagtgttgggatgccaaagcactgagcacaagattttgataccaaacgcatctgttttgtctctctcccagcttcagtgttcccctgtttcgtcttcacagcctcctttgtccggcgatgatgccagaactctcctccacaaggttttgggatggagtatagtggataatgaagcgggtggtctgaaaataaggtgtatgtggaaagtgaaggattttgggtgcggtgttgaactcataaacaggatccataaggttgctgaagcttctggtcattacccttctcttcacttggaaagtcctacccaagttcgagctgaactatttacctcttctatcggagggttgagcatgaatgatttcataatggcggctaaaatagatgatatcaagacttctgatctttcccctaggaaaagagcttgggcgtgatcttcttttcattattttggaacatttttgtttgatagtatgtaatgtatgtgatgtattctaaattgtgtgtgatcggtctacatgtcgagttatatagaaagcattgtcataaccgcc

SEQ ID NO: 607 - protein, 220 aa, Arabidopsis thaliana
  misc_feature (1)..(220): Ceres CLONE ID no. 8788
  misc_feature (1)..(220): Also Known As Ceres CDNA ID no. 23370421
  misc_feature (1)..(220): Also Known As Ceres GEMINI ID no. 555D2
  misc_feature (158)..(209): Pfam Name: Pterin_4a Pfam Description: Pterin 4 alpha carbinolamine dehydratase
MAATSSSPPCNISASSLLLRQPSRSILKVFGLLPPVSRNNRKLGRLTVTRSNLAQDFLGDFGARDPYPEEIASQFGDKVLGCQSTEHKILIPNASVLSLSQLQCSPVSSSQPPLSGDDARTLLHKVLGWSIVDNEAGGLKIRCMWKVKDFGCGVELINRIHKVAEASGHYPSLHLESPTQVRAELFTSSIGGLSMNDFIMAAKIDDIKTSDLSPRKRAWA

SEQ ID NO: 608 - protein, 210 aa, Triticum aestivum
  misc_feature (1)..(210): Ceres CLONE ID no. 1032823
  misc_feature (1)..(210): Functional Homolog of  Ceres CLONE ID no. 8788 at SEQ ID NO. 607 with e-value of 4.19E-46 and percent identity of 54.2
MALMLSPAATFLPVAGKPAAAMRNLLFGTSSKGRSVRKVVAMADILGDFGARDPFPEEIASNFGEKTLGNVDTLHRILIPTLSVLSLSRVPLDADPAPLSEEDARKLLFKVVGWRLLFPSKGDSDVLKLECVWKVRDQACGDELIARINKTLDGAGHAPAALQFEAPNQVRAQLYTPSVGGLSANDFIIAARIDQIKTKDLLPKKRVWAC

SEQ ID NO: 609 - protein, 218 aa, Zea mays
  misc_feature (1)..(218): Ceres CLONE ID no. 314156
  misc_feature (1)..(218): Functional Homolog of  Ceres CLONE ID no. 8788 at SEQ ID NO. 607 with e-value of 3.59E-40 and percent identity of 51.9
MALRLSLAPPAAAPAASTCRCSSASFIRPGVAVGSRRGRARGCVVAMADLLGDLGARDPFPEEIESQFGEKVLGNVDTLHQILIPTLSALSLASLPLQPDAEPLSLDDARRLLFKVVGWRLVLSDGDGDEQRPARLQCVWKVRDETCGQELIARINAALHGAGHAPATLAFEAPNQVTAELSTPSAAGDSLTVNDYIVAARIDKVKTLDLIPKKRAWA

SEQ ID NO: 610 - DNA, 992 bp, Arabidopsis thaliana
  misc_feature (1)..(992): Ceres CLONE ID no. 92102
  misc_feature (1)..(992): Also Known As Ceres CDNA ID no. 23375846
  misc_feature (1)..(992): Also Known As Ceres GEMINI ID no. 532F1
attcccacttccacacatacacatatacaacagagcaagagagtcaatcaagtagagtgaagatggcaactaaacaagaagctttagccatcgatttcataagccaacaccttctcacagactttgtttccatggaaactgatcacccatctctttttaccaaccaacttcacaactttcactcagaaacaggccctagaaccatcaccaaccaatcccctaaaccgaattcgactcttaaccagcgtaaaccgcccttaccgaatctatccgtctcgagaacggtttcaacaaagacagagaaagaggaagaagagaggcactacaggggagtgagacgaagaccgtggggaaaatacgcggcggagattagggatccgaacaaaaagggttgtaggatctggcttgggacttacgacactgccgtggaagctggaagagcttatgaccaagcggcgtttcaattacgtggaagaaaagcaatcttgaatttccctctcgatgttagggttacgtcagaaacttgttctggggaaggagttatcggattagggaaacgaaagcgagataagagttctccgccggaagaggagaaggcggctagggttaaagtggaggaagaagagagtaatacgtcggagacgacggaggctgaggttgagccggtggtaccattgacgccgtcaagttggatggggttttgggatgtgggagcaggagatggtattttcagtattcctccgttatctccgacgtctcccaacttttccgttatctccgtcacttaaaacttcggaaaagtcaacgtacgatgacgttttcacttgcgtcactctcatgatttcatttattcttgtataatataaaggtagcggtagtgtgcaaatatcaaataagtagtttaattagtaccaatcattttattcattattttttttagtagaatatttggatgttgaaaatataaatttaattttgtatttgttgatgtt

SEQ ID NO: 611 - protein, 241 aa, Arabidopsis thaliana
  misc_feature (1)..(241): Ceres CLONE ID no. 92102
  misc_feature (1)..(241): Also Known As Ceres CDNA ID no. 23375846
  misc_feature (1)..(241): Also Known As Ceres GEMINI ID no. 532F1
  misc_feature (86)..(150): Pfam Name: AP2 Pfam Description: AP2 domain
MATKQEALAIDFISQHLLTDFVSMETDHPSLFTNQLHNFHSETGPRTITNQSPKPNSTLNQRKPPLPNLSVSRTVSTKTEKEEEERHYRGVRRRPWGKYAAEIRDPNKKGCRIWLGTYDTAVEAGRAYDQAAFQLRGRKAILNFPLDVRVTSETCSGEGVIGLGKRKRDKSSPPEEEKAARVKVEEEESNTSETTEAEVEPVVPLTPSSWMGFWDVGAGDGIFSIPPLSPTSPNFSVISVT

SEQ ID NO: 612 - DNA, 1010 bp, Brassica napus
  misc_feature (1)..(1010): Ceres CLONE ID no. 955048
  misc_feature (1)..(1010): Also Known As Ceres CDNA ID no. 23420635
  misc_feature (1)..(1010): Also Known As Ceres GEMINI ID no. 537E8
atgtctgcagcactgagctcgtctctctacatctccccaaagaaaccttcatctccacagctatctcaatccacgaaacccaccaccatcaaaaccactctccacacccaccctctcttctccgtcgccgaccaagccgtaaccctccagatgaaagagaagatcctatgcctcgagctcatgggaatcgactccggcaaagccctctctctcaaccctttcctccgctcagcctcccttgactccgtcgaagccgtcctcaacttcctccaatcaaaaggaatctacccgaacgacctgccaaggatcttggggatgtgtcccaagatcctcacttcagacatcagaacagaactcaaccctgttttcacgttcctgtcgagtgatctccatgtccccgataatgcgttcagaagagtggtcaagaaatgtccgaggctactgatcagcaccgtggaggaccagctcaagcctgctctgttctacttgcagagacttggtttcaaggatcttgatgctcttgcttaccaagatcctgtcttgttggtgtctagtgttgaacmcactctcatcccaaagcttagattcttggagagtatagggttytcgagatcagaggcgattggaatgatccttagatgtccggctctattcacatttagcatagagaacaactttaaaccaaagctggattacttcatgtgcgagatcaaaggtaaactggagaatytaaaggagtttccgcagtattttgcgtttagtctagagaaaaggataaagccgaggcacctgaaatytatggagagaggtttagagttgccattggcattgatgcttaagagcmctgatgaagagtttgagcaattgctcctgcagacagagccatytccagtggtaaatgtgtaatgttattgttgtaaatggtggaaaaatgttacagtgtttattaatagtaattttaacattgttccatgtgtatgtgaaattgattgtatatgcctaggggttgg

SEQ ID NO: 613 - protein, 301 aa, Brassica napus
  misc_feature (1)..(301): Ceres CLONE ID no. 955048
  misc_feature (1)..(301): Also Known As Ceres CDNA ID no. 23420635
  misc_feature (1)..(301): Also Known As Ceres GEMINI ID no. 537E8
  misc_feature (19)..(288): Pfam Name: mTERF Pfam Description: mTERF
  misc_feature (188)..(188): Xaa is any aa, unknown, or other
  misc_feature (266)..(266): Xaa is any aa, unknown, or other
  misc_feature (282)..(282): Xaa is any aa, unknown, or other
  misc_feature (296)..(296): Xaa is any aa, unknown, or other
MSAALSSSLYISPKKPSSPQLSQSTKPTTIKTTLHTHPLFSVADQAVTLQMKEKILCLELMGIDSGKALSLNPFLRSASLDSVEAVLNFLQSKGIYPNDLPRILGMCPKILTSDIRTELNPVFTFLSSDLHVPDNAFRRVVKKCPRLLISTVEDQLKPALFYLQRLGFKDLDALAYQDPVLLVSSVEXTLIPKLRFLESIGFSRSEAIGMILRCPALFTFSIENNFKPKLDYFMCEIKGKLENLKEFPQYFAFSLEKRIKPRHLKXMERGLELPLALMLKSXDEEFEQLLLQTEPXPVVNV

SEQ ID NO: 614 - protein, 303 aa, Arabidopsis thaliana
  misc_feature (1)..(303): Public GI No. 3128213
  misc_feature (1)..(303): Functional Homolog of  Ceres CLONE ID no. 955048 at SEQ ID NO. 613 with e-value of 0.0 and percent identity of 88.6
MSAALSSSLYISPKKPSCPQQSQSTFLSTKPTTIKTNLHSHPLFTVADQTVTLQMKEKILCLELMGIDSGKALSLNPCLCSAPLDSIQSVLHFLQSKGIYPNDLPRILGMCPKILTSDVRTELYPVFMFLSNDLHVPENAFRRVIKKCPRLLISSVEDQLKPALFYLQRLGLKDLEALAYQDPILLVSSVEHTLIPKLRFLESIGFSRPEAIGMILRCPALFTFSIENNFKPKLDYFMSEIKGKLENLKEFPQYFAFSLEKRIKPRHLESMERGLELPLSLMLKSTDEEFEQLLTNPSSVANV

SEQ ID NO: 615 - DNA, 569 bp, Arabidopsis thaliana
  misc_feature (1)..(569): Ceres CLONE ID no. 9552
  misc_feature (1)..(569): Also Known As Ceres GEMINI ID no. 554E1
aaaatctcgaaaccctaattattctaagattctaatttgtgaagtttgtgaggttttagggatgggttacaatttctacatgagagtgtatgaggttgttgatgatgcttcaacggatgcaatcatatcgtggagcgaaagcaacaacagtttcattatctggaatgttggagagttttacagaaggattctgcctaaatatgtagacttgggcacaaacctctcacggtttttctccaaccttcgttctcatgggttcaaaatagttaaaggaagaactggagtattggaatttggacatgaagattttgtcagagataaactggagcttatgaagaagatggttagcgataaacgtaaagcaaggaaagcagctaaatccaaagcaaggaaagctagagttcaagtcgagtttctcttccaacacttgcaaatttgatccattaaatcagtcttcttttttatgtatatattcatctccaagtagatcaagtctaagaacttttcaatagtatgtatctctctttataggaaccctctttatatgcctagtctttgattcttctctc

SEQ ID NO: 616 - protein, 125 aa, Arabidopsis thaliana
  misc_feature (1)..(125): Ceres CLONE ID no. 9552
  misc_feature (1)..(125): Also Known As Ceres GEMINI ID no. 554E1
  misc_feature (10)..(47): Pfam Name: HSF_DNA-bind Pfam Description: HSF-type DNA-binding
MGYNFYMRVYEVVDDASTDAIISWSESNNSFIIWNVGEFYRRILPKYVDLGTNLSRFFSNLRSHGFKIVKGRTGVLEFGHEDFVRDKLELMKKMVSDKRKARKAAKSKARKARVQVEFLFQHLQI

SEQ ID NO: 617 - DNA, 856 bp, Brassica napus
  misc_feature (1)..(856): Ceres CLONE ID no. 968026
  misc_feature (1)..(856): Also Known As Ceres CDNA ID no. 23419225
  misc_feature (1)..(856): Also Known As Ceres GEMINI ID no. 553C6
atcatccaactttgagtataacatttaattttgctcttctctctattctcttaaagatccaatatatcgcatggctgaggttatgctaccgatgaaaatggagatggctaacgatccttccaagtttacatcacctgatcttcttcatgttctcgccgtcgacgacagtcacgttgatcggaaattcatagaacgcttgctcaaagtctcttcctgtaaagttaccgttgttgatagtgcgacaagagctctgcaataccttggactagacgtaaacgagaaacccatcggttgtaaggatttgaaagttaatttgatcatgacggattactctatgcccggaatgactggatatgaactcttgaagaagatcaaagaatcgtcagctttcagagatgtgcctgtggtggttatgtcatctgagaacattttgtctcgtattgatagatgtcttgaagaaggggctgaagatttcttactgaagccggtaaaactctcggatgtaagaagaataagagattctctgattaaagttgaagatttatctttcacaaagagtattaacaagagagagctagaaacagagaatgtctactccttggactcatctgttcccttgcagctcaaacgcacaaagatytgagctttcccaagcagactaccatgacatgatctttaaaaagcttaatcacctatacaattttccaccccctggtgtctttttttttgctgagtaaaaaactcagtgttgacagagaaacagggcttattcatagactatgttagcaatgtaaatggtagagataaaccmcaaaactattatattattattcattagagatgtcatgtttttttt

SEQ ID NO: 618 - protein, 190 aa, Brassica napus
  misc_feature (1)..(190): Ceres CLONE ID no. 968026
  misc_feature (1)..(190): Also Known As Ceres CDNA ID no. 23419225
  misc_feature (1)..(190): Also Known As Ceres GEMINI ID no. 553C6
  misc_feature (25)..(157): Pfam Name: Response_reg Pfam Description: Response regulator receiver domain
MAEVMLPMKMEMANDPSKFTSPDLLHVLAVDDSHVDRKFIERLLKVSSCKVTVVDSATRALQYLGLDVNEKPIGCKDLKVNLIMTDYSMPGMTGYELLKKIKESSAFRDVPVVVMSSENILSRIDRCLEEGAEDFLLKPVKLSDVRRIRDSLIKVEDLSFTKSINKRELETENVYSLDSSVPLQLKRTKI

SEQ ID NO: 619 - protein, 186 aa, Arabidopsis thaliana
  misc_feature (1)..(186): Public GI No. 28466913
  misc_feature (1)..(186): Functional Homolog of  Ceres CLONE ID no. 968026 at SEQ ID NO. 618 with e-value of 1.59E-77 and percent identity of 87.0
MAEVMLPRKMEILNHSSKFGSPDPLHVLAVDDSHVDRKFIERLLRVSSCKVTVVDSATRALQYLGLDVEEKSVGFEDLKVNLIMTDYSMPGMTGYELLKKIKESSAFREVPVVIMSSENILPRIDRCLEEGAEDFLLKPVKLSDVKRLRDSLMKVEDLSFTKSIQKRELETENVYPVHSQLKRAKI

SEQ ID NO: 620 - protein, 184 aa, Arabidopsis thaliana
  misc_feature (1)..(184): Public GI No. 4678318
  misc_feature (1)..(184): Functional Homolog of  Ceres CLONE ID no. 968026 at SEQ ID NO. 618 with e-value of 1.49E-65 and percent identity of 75.4
MAEVLRPEMLDISNDTSSLASPKLLHVLAVDDSMVDRKFIERLLRVSSCKVTVVDSATRALQYLGLDGENNSSVGFEDLKINLIMTDYSMPGMTGYELLKKIKESSAFREIPVVIMSSENILPRIDRCLEEGAEDFLLKPVKLADVKRLRDSLMKAEERAFKNIMHKRELEANDIYSQLKRAKI

SEQ ID NO: 621 - DNA, 653 bp, Brassica napus
  misc_feature (1)..(653): Ceres CLONE ID no. 969750
  misc_feature (1)..(653): Also Known As Ceres GEMINI ID no. 552G6
acaaacacacaacacaacaatggattacatcgacaacaccgtcgaaactcaatcaaagtacaaaggcatccgtcgccggaaatgggggaaatgggtatcggagattcgagttccgggaactcgcgaccgtctctggttaggctcattctccacggcggaaggcgcagccgtggcgcacgacgtggctttctactgtttacaccaaccaaactcgctcgaatctctcaacttccctcacttgcttcctccttccatagtttccaagacttcgccgaggtctatccagcaagctgcttctaatgccggaatggccgttgacgccggaatcgttaacagctgtgatcacgcgtccgggaactctgggaatggagatacaacgacggcgtattgtgagaatggaggtgcgttgaatatatcagtgtatgattatttggacggtcacgatcacgtttgaacttcatcttcttgttttttcgtttaaagatacagctactcaaaagaaacagtgatggagcctggtgtgtaagcaaacaaagcgttgtaaatataattatacgtttatgtttcgctgttggcccaattcaagaaacttttgttgtacgattatatatatttttattttgaatgccttcaagaggattataatgcgagtg

SEQ ID NO: 622 - protein, 144 aa, Brassica napus
  misc_feature (1)..(144): Ceres CLONE ID no. 969750
  misc_feature (1)..(144): Also Known As Ceres GEMINI ID no. 552G6
  misc_feature (12)..(77): Pfam Name: AP2 Pfam Description: AP2 domain
MDYIDNTVETQSKYKGIRRRKWGKWVSEIRVPGTRDRLWLGSFSTAEGAAVAHDVAFYCLHQPNSLESLNFPHLLPPSIVSKTSPRSIQQAASNAGMAVDAGIVNSCDHASGNSGNGDTTTAYCENGGALNISVYDYLDGHDHV

SEQ ID NO: 623 - DNA, 1174 bp, Arabidopsis thaliana
  misc_feature (1)..(1174): Ceres CLONE ID no. 99075
  misc_feature (1)..(1174): Also Known As Ceres CDNA ID no. 23372744
  misc_feature (1)..(1174): Also Known As Ceres GEMINI ID no. 554G11
atttccccatctagaagctctctctcgactctctcgtctgtttctatctttcgtggtacctcttctcttctctttccttttctgagtttctgttaattttactctctcttttttttcttctctgttgcttatataataagatttgtctttctgttccaaaaactcgttttctctaattcttctctgcgattctaatcaaattccgtatagatgcgtcgctcttcatcaaagaagaaatcaggtcaatcaactgaatcagtcaccacggatctctttcgctcagcttcgagcaaggcctcgaataaagagatggatcgaattgatcacttatttaatcagtatgccaataaatcttccagcctgattgatcctgaaggaatagaggaactatgctccaatttggaagtgtcacatactgatatcagaatcttgatgcttgcttggaagatgaaagctgagaaacaaggttactttacacatgaggagtggagaagaggcctcaaggctttaagagctgatacgatcaataagttgaagaaagcccttccggagcttgagaaagaggtcaggaggccatcaaattttgcagatttctatgcttatgccttctgttattgtttaacagaggaaaaacagaagagcatagacatagagactatatgtcaactcctagagatcgtcatgggatctacatttcgagcccaagttgactactttgttgagtatttraagatccaaaacgactacaaagtgataaacatggaccaatggatgggactttaccggttctgtaacgagataagtttcccggacatggggaactacaatccagagcttgcatggccattgattcttgacaattttgttgagtggattcaagaaaaacaagcctgaaatcatttctgagtcccctcaagtcgaagcttcaaatctctgcaggatgatcagtgggctctctcatcaaaacagattcagcacatttttacttcagttttcatctttcaaacattaaaaaaagacacattatatgattcttgttacatgtgattaacttcaatagagggaacacataatgtttgatttattacatcaagttctgttagtagtaaccaatgatttcgaatttgcttgtaaacacgttgttaccaaatttataaccatcagattcattctg

SEQ ID NO: 624 - protein, 227 aa, Arabidopsis thaliana
  misc_feature (1)..(227): Ceres CLONE ID no. 99075
  misc_feature (1)..(227): Also Known As Ceres CDNA ID no. 23372744
  misc_feature (1)..(227): Also Known As Ceres GEMINI ID no. 554G11
  misc_feature (105)..(223): Pfam Name: DUF298 Pfam Description: Domain of unknown function (DUF298)
MRRSSSKKKSGQSTESVTTDLFRSASSKASNKEMDRIDHLFNQYANKSSSLIDPEGIEELCSNLEVSHTDIRILMLAWKMKAEKQGYFTHEEWRRGLKALRADTINKLKKALPELEKEVRRPSNFADFYAYAFCYCLTEEKQKSIDIETICQLLEIVMGSTFRAQVDYFVEYLKIQNDYKVINMDQWMGLYRFCNEISFPDMGNYNPELAWPLILDNFVEWIQEKQA

SEQ ID NO: 625 - protein, 237 aa, Arabidopsis thaliana
  misc_feature (1)..(237): Public GI No. 25518040
  misc_feature (1)..(237): Functional Homolog of  Ceres CLONE ID no. 99075 at SEQ ID NO. 624 with e-value of 3.79E-116 and percent identity of 98.6
MRRSSSKKKSGQSTESVTTDLFRSASSKASNKEMDRIDHLFNQYANKSSSLIDPEGIEELCSNLEVSHTDIRILMLAWKMKAEKQGYFTHEEWRRGLKALRADTINKLKKALPELEKETESFLFLSLEGQRPSNFADFYAYAFCYCLTEEKQKSIDIETICQLLEIVMGSTFRAQVDYFVEYLKIQNDYKVINMDQWMGLYRFCNEISFPDMGDYNPELAWPLILDNFVEWIQEKQA

SEQ ID NO: 626 - protein, 228 aa, Brassica napus
  misc_feature (1)..(228): Ceres CLONE ID no. 971321
  misc_feature (1)..(228): Functional Homolog of  Ceres CLONE ID no. 99075 at SEQ ID NO. 624 with e-value of 9.39E-104 and percent identity of 87.2
MRRSSAASKKKFDSITSSTTDLFRSGPSKATSKEMDRIDHLFNQYANTSSNLIDPEGIEELCSNLEVPHTDIRILMLAWKMKAEKQGYFTQEEWRRGLKALRADTLSKLKKALPELEKEVRRQSNFADFYAYAFRYCLTEEKQKSIDIETICQLLDIVMGSTFRAQVDYFVEYLKIQNDYKVINMDQWMGFYRFCNQISFPEMTEYNPELAWPLVLDSFVEWISEKQA

SEQ ID NO: 627 - protein, 228 aa, Glycine max
  misc_feature (1)..(228): Ceres CLONE ID no. 516604
  misc_feature (1)..(228): Functional Homolog of  Ceres CLONE ID no. 99075 at SEQ ID NO. 624 with e-value of 4.99E-66 and percent identity of 55.4
MPRPKRKAAPPITSSDVDSSLRTEPKKSTTKQFDRIDKLFESYANKSLGLIDPDGIEALCKDVHVDHTDVRMLILAWKLKAEKQGYFSKDEWQKGLKCLGADTLPKLRKAINGLKKEVTVPECFEDFYSYAFQYCLTEEKQRSVDIETICELLNVVLRSEFPTQVNLLTEYLKIQNDYRALNIDHWRNFYRFFKEVSLTDLRSYDSSQAWPVILDNFVDWLKEKEEKI

SEQ ID NO: 628 - protein, 220 aa, Zea mays
  misc_feature (1)..(220): Ceres CLONE ID no. 1403244
  misc_feature (1)..(220): Functional Homolog of  Ceres CLONE ID no. 99075 at SEQ ID NO. 624 with e-value of 1.89E-73 and percent identity of 64.7
MRRTSKKSSSSTATASAGPTKAVSKEVERIDQFFYTYADNSSGMIDPEGIETLCSHLEVPHTDVRILMLAWKMGCDKQGYFTLDEWRTGLKALRADSISKLKKAFPELVQEVTRPSNFQDFYIYAFRYCLTEDKKKCIEIPVACELLNLVLGLQFRPQVDKLNNYLMYQNDYKVITMDQWMGFIRFCNEINFPSLDNYDSDLAWPLILDNFVEWLRENKS

SEQ ID NO: 629 - DNA, 1794 bp, Arabidopsis thaliana
  misc_feature (1)..(1794): Ceres CLONE ID no. 99519
  misc_feature (1)..(1794): Also Known As Ceres CDNA ID no. 23363833
  misc_feature (1)..(1794): Also Known As Ceres GEMINI ID no. 555D6
gaaaaggatttttaattttcggagaggaagaagaagagagagatattgaagagcgctgaaggcggaaaagactattttgacctcgtcgtctccgtagatcatttttcttcagctcttcttcttcctctttctccgattctccttcttttgattttatctatccgccatgaacgagaaagccaatgtctctaaggagcttaatgcccgccatagaaagattcttgaagggcttcttaaacatccagagaacagagaatgtgctgactgcaaaacaaaaggtccaagatgggctagtgttaatttaggtatctttatctgcatgcaatgttctgggattcacaggagtctcggggtacacatatcgaaggttcgatctgccactctggacacatggctccccgagcaggttgcatttatacagtcaatgggaaatgataaagcaaatagttactgggaagcagagctacccccaaactatgatagagttggaattgagaattttatacgtgcaaagtatgaagagaagagatgggtttctagaggggaaaaggctagatcacctcctagagtcgagcaggaaaggcggaaatctgtggagacaagtgggccgggatatgagcatggacatagtagtagtcctgtaaatttgtttgaggagaggaaaactattccagcatctagaacaagaaataatgttgctgcaacgagaataaatcttcccgtgcctccccaaggacccagtcaggttataaagccacagcagaaaatggagtctgcagctactccagtagagagggagaaacaagcagtaaatgttgcaccagcatcagatcctccaaaggtggattttgctactgatctgtttaacatgctatcaatggatgattcgactacaaatacctcagaggcaactcctggcgatactcctgccgatgataactcatgggctggctttcagtctgctggaagtggtcaaacggcagagaaaattgtcacagccaagcctgctgagagcagttctcctccagcttcatcttctgactttgaggatttgtttaaggacacacctaatttaacaactcaacaagcaccaaaagatgtgaaaggcgatatcatgagcctgtttgagaagacgaatatagtatcgccttttgccatgcatcagcaacaggttgctatgctcgctcagcagcaagccctttacatggctgcagcgaaagctgctggaggcactccaaacggcgtgaatcaacaagctattgctaatgctcttaacgtagcttctgcaaattggtcaaaccccggcggctaccagatccccggaatgactaaccccgtaggtggtcaagctgatctccagaaacttatgcaaaacatgaatatgaacgcaaacatgaacacgagacccgcacaaccgcaagagaacactctacaatacccatcatccagtttctacacaatgggtcaagctaatcaagtgaacggtatgaccccaaactcaaccggtaaacctcagtcatcatccgcaacccaaccaacaagcaccacaccatcttcacaatcaggcaaagactttgatttctcttccttgatggatggaatgttcacaaaacattgatcaagagagagagactttttctgaatttgcctttacatctttgttctaaatttgaagaaccaaaagaatatatatacaatcatctctggacagtttttctctgttaaacatatattttcttttctttggaactgtgttgtagccgagctttgatttatgattttactcgattgtcg

SEQ ID NO: 630 - protein, 483 aa, Arabidopsis thaliana
  misc_feature (1)..(483): Ceres CLONE ID no. 99519
  misc_feature (1)..(483): Also Known As Ceres CDNA ID no. 23363833
  misc_feature (1)..(483): Also Known As Ceres GEMINI ID no. 555D6
  misc_feature (16)..(130): Pfam Name: ArfGap Pfam Description: Putative GTPase activating protein for Arf
MNEKANVSKELNARHRKILEGLLKHPENRECADCKTKGPRWASVNLGIFICMQCSGIHRSLGVHISKVRSATLDTWLPEQVAFIQSMGNDKANSYWEAELPPNYDRVGIENFIRAKYEEKRWVSRGEKARSPPRVEQERRKSVETSGPGYEHGHSSSPVNLFEERKTIPASRTRNNVAATRINLPVPPQGPSQVIKPQQKMESAATPVEREKQAVNVAPASDPPKVDFATDLFNMLSMDDSTTNTSEATPGDTPADDNSWAGFQSAGSGQTAEKIVTAKPAESSSPPASSSDFEDLFKDTPNLTTQQAPKDVKGDIMSLFEKTNIVSPFAMHQQQVAMLAQQQALYMAAAKAAGGTPNGVNQQAIANALNVASANWSNPGGYQIPGMTNPVGGQADLQKLMQNMNMNANMNTRPAQPQENTLQYPSSSFYTMGQANQVNGMTPNSTGKPQSSSATQPTSTTPSSQSGKDFDFSSLMDGMFTKH

SEQ ID NO: 631 - protein, 484 aa, Glycine max
  misc_feature (1)..(484): Ceres CLONE ID no. 478849
  misc_feature (1)..(484): Functional Homolog of  Ceres CLONE ID no. 99519 at SEQ ID NO. 630 with e-value of 0.0 and percent identity of 63.0
MNSKANVSKELNAKHKKILEGLLKLPENRGCADCKAKGPRWASVNLGIFICMQCSGIHRSLGVHISKVRSATLDTWLPDQVAFIQSMGNEKANSFWEAELPPNYDRVGIENFIRAKYDEKRWIPRDGNSKTPSGLREEKSPSHWQRPVERSGYAAVSENKFEERKKIQPSNAISTTRINVPAPPRASEQVTPITKPQHVEKVEPVAPQPPASQPQAETSKQATDTVQNIPPKVDYATDLFNMLSMDGPNENGSEAAGTTTDDNHWAGFQSAAEVSTAEKTSPLKAADSTPVSASGIEDLFKDLSPVTPSLTPEKPQKDVKNDIMRLFEKGNIVSPFSMHQQQLGMLAHQQSLLMAAAAKSTGGDPRYPANIQQPRPPNVPIQSWPATGYSIPGVMPMGGQGDLQKLMQGQPRSMTPAHFAGSSVQYPPSSFYGMGQVAPPVNGMMTTMGVNKPQSGAPAVSSSPTQSAKDYDFSSLTQGMFTKQ

SEQ ID NO: 632 - protein, 475 aa, Triticum aestivum
  misc_feature (1)..(475): Ceres CLONE ID no. 575526
  misc_feature (1)..(475): Functional Homolog of  Ceres CLONE ID no. 99519 at SEQ ID NO. 630 with e-value of 1.49E-112 and percent identity of 55.0
MNEKASVSKELNARHKKILEGLLRLPENRECADCKSKGPRWASVNLGIFVCMQCSGIHRSLGVHISKVRSATLDTWLPEQVAFIQSMGNEKANGYWEAELPPNYDRVGIENFIRAKYEDKRWIPRNGTSKLPSSARDEKSSESQASHANRGGHAQKPSFEQHRVSPAATKRTVPVASRMHTQASPQPKAELPVPKVASPPQPAKSPAKVDVTPPKVHQPSVAPPPKVDYAIDLFNMLSMDGTTEKEPVSSSNDDNAWDGFQSAEPAPNSEKKDTAKPVESKAQSTSGIEDLFKDSPAVAASSAPVASKSNPQTDIMSLFEKSNMVSPFAIHQQQLAFMTQQQALLMAALKSGNAPQMVPGNAPQMVPGNASVLNANGSNAPNGSLPSHSWPNLGYQNPASIPAAAPQNGVAKAGNNNQDFFSGNFGFGSPGKPANGATTAGANKSASTPTSSTLPSQSGKEYDFSSLTQGMFSKR

SEQ ID NO: 633 - protein, 468 aa, Zea mays
  misc_feature (1)..(468): Ceres CLONE ID no. 282105
  misc_feature (1)..(468): Functional Homolog of  Ceres CLONE ID no. 99519 at SEQ ID NO. 630 with e-value of 8.69E-117 and percent identity of 58.0
MNEKASVSKELNAKHKKILEGLLRHPENRECADCKSKGPRWASVNLGIFICMTCSGIHRSLGVHISKVRSATLDTWLPEQVAFIQSMGNEKANSYWEAELPPNYDRVGIENFIRAKYEDKRWVPRNGTSKSSSSVRDEKSQESPASANRSGHGHRSSFEQNRASPALPSKVAHAASRISSQASPQPPKVETPVPKVVLPPQSQKSPAKVDATPPKVEKPSVTPPPKVDYATDLFNMLSMDGTTEKESASSSNDDNGWDGFQSAQPVPSSEKKDSAKPAESKTQSTSGMEDLFKDSPAVPLSSAPAVSQVNAKNDIMSLFEKSNMVSPFAAHQQQLALMSQQQALLMAALKAGNAPQMMIPGTANQLNANGTLPFQNWTNLYQNPGSTPAAAQNGATKVANNNQDFSSGTFGFGTPGVYNISPTVPANGATTAGAINNGTASTASSTLPSQSGKDYDFSSLTQGFFTKR

SEQ ID NO: 634 - protein, 476 aa, Oryza sativa subsp. japonica
  misc_feature (1)..(476): Public GI No. 50510178
  misc_feature (1)..(476): Functional Homolog of  Ceres CLONE ID no. 99519 at SEQ ID NO. 630 with e-value of 1.20E-110 and percent identity of 58.3
MNEKASVSKELNAKHKKILEGLLRLPENRECADCKSKGPRWASVNLGIFICMQCSGIHRSLGVHISKVRSATLDTWLPEQVAFIQSMGNEKSNSYWEAELPPNYDRVGIENFIRAKYEDKRWIPRNGSSRPSSGARDEKSSESQTSVNRGGHNQRSSFEQHRTSPAAVSKIAPVVSRTPTQAPHQPKAQPSVPKVSPPQPEKSPPNATPPKVERPSVAPPPKVDYATDLFNMLSMDGTTEKEAESSSNDDSAWEGFQSAEPVPSSDKKDSAKPVESKPQSTSGIEDLFKDSPAVTVSSAPAAPQVNVKNDIMSLFEKSSMVSPYAVQQQQLAFMTPQQLALLSQQQALLMAALKAGNAPQMIPGNASLLNGNGSNPANGGLPSQSWTNLAYQNPGLAPVAAQNGATKVANNNQEFSFGNFNFSTPGAYNTSSSVPANGAASAAANKSTSPTSSSLPSQSGKEYDFSSLTQGLFSKR

SEQ ID NO: 635 - DNA, 838 bp, Arabidopsis thaliana
  misc_feature (1)..(838): Ceres CLONE ID no. 3774
  misc_feature (1)..(838): Also Known As Ceres GEMINI ID no. 535D3
aaatcgaaaactaattgtatcatcctcttccttgcgttctctctttctctctctcgccgacgacgaaaacatgggtgccaaggcgaagaaagctttgaagaagaacatgaagaaggttgctgcttcggcttcttcttctcagctacctcttccccagaacccgaaaccttcagctgattttttgccactagaaggaggtccagctcgaaaagctccagttaccaccccacctcttcagaataaagctactgtgctatacatcggtagaatccctcatggcttctatgagactgagattgaagctttcttctcgcagtttggaacagttaagagagttagagtcgccagaaacaaaaagactgggaaatcaaagcattttgggttcatacagtttgaggaccctgaggtggcggaaattgcagcgggtgcaatgaatgattatttgttgatggagcacatgcttaaagtccatgtcattgaaccagaatgttaaacccaatctgtggagagggtttaaatgtaacttcaaaccagtggattcggttcagattgagcgaagacaacttaataaggaaaggacattggaagagcataggaaaatgttgcagaagatagttaaaaaggatcagaaaaggaggaagagaatcgaagccgctggaatagaatacgaatgccctgagcttgttggaaacacacagccagtcccgaagaggatcaagtttagtgaagaagactaaaagctgaagctgaacaacacttttccgataaccttttttgaatagaaatctgttctgttgtactcttgatattggatcaataactaaactttaaagtttgc

SEQ ID NO: 636 - protein, 140 aa, Arabidopsis thaliana
  misc_feature (1)..(140): Ceres CLONE ID no. 3774
  misc_feature (1)..(140): Also Known As Ceres GEMINI ID no. 535D3
  misc_feature (62)..(133): Pfam Name: RRM_1 Pfam Description:
MGAKAKKALKKNMKKVAASASSSQLPLPQNPKPSADFLPLEGGPARKAPVTTPPLQNKATVLYIGRIPHGFYETEIEAFFSQFGTVKRVRVARNKKTGKSKHFGFIQFEDPEVAEIAAGAMNDYLLMEHMLKVHVIEPEC

SEQ ID NO: 637 - protein, 130 aa, Brassica napus
  misc_feature (1)..(130): Ceres CLONE ID no. 1035997
  misc_feature (1)..(130): Functional Homolog of  Ceres CLONE ID no. 3774 at SEQ ID NO. 636 with e-value of 4.29E-54 and percent identity of 89.7
MGAKAKKALKKNMKKITASAAASSSSQLAAPQNTKPSADFLPLEGGPARKAPATKTIENKATVLYIGRLPHGFYETEIEAFFTQFGTVKRVRVARNKKTGKSKHFGFIQFEDPEVAEIAAGAMNDYLLLE

SEQ ID NO: 638 - protein, 142 aa, Brassica napus
  misc_feature (1)..(142): Ceres CLONE ID no. 982730
  misc_feature (1)..(142): Functional Homolog of  Ceres CLONE ID no. 3774 at SEQ ID NO. 636 with e-value of 1.90E-58 and percent identity of 88.3
  misc_feature (122)..(122): Xaa is any aa, unknown, or other
MGAKAKKALKKNMKKISASSSSQLAVPQNPKPSADFLPLGGGPARKAPVTKPLESKATVLYIGRLPHGFYETEIEAFFTQFGTVKRVRFARNKKTGKSKHFGFIQFEDPEVAEIAAGAMNDXLLLEHMLQVRVIPPEHVKPN

SEQ ID NO: 639 - DNA, 1533 bp, Arabidopsis thaliana
  misc_feature (1)..(1533): Ceres CLONE ID no. 4346
  misc_feature (1)..(1533): Also Known As Ceres GEMINI ID no. 534F8
gctcctttctcgtctctgtcttcttcgtcctcattcgttttaaagcatcaaaatttcatcaacccaaaatagattaaaaaaatctgtagctttcgcatgtaaatctctctttgaaggttcctaactcgttaatcgtaactcacagtgactcgttcgagtcaaagtctctgtctttagctcaaaccatggctagtaacaaccctcacgacaacctttctgaccaaactccttctgatgatttcttcgagcaaatcctcggccttcctaacttctcagcctcttctgccgccggtttatctggagttgacggaggattaggtggtggagcaccgcctatgatgctgcagttgggttccggagaagaaggaagtcacatgggtggcttaggaggaagtggaccaactgggtttcacaatcagatgtttcctttggggttaagtcttgatcaagggaaaggacctgggtttcttagacctgaaggaggacatggaagtgggaaaagattctcagatgatgttgttgataatcgatgttcttctatgaaacctgttttccacgggcagcctatgcaacagccacctccatcggccccacatcagcctacttcaatccgtcccagggttcgagctaggcgtggtcaggctactgatccacatagcatcgctgagcggctacgtagagaaagaatagcagaacggatcagggcgctgcaggaacttgtacctactgtgaacaagaccgatagagctgctatgatcgatgagattgtcgattatgtaaagtttctcaggctccaagtcaaggttttgagcatgagccgacttggtggagttggtgcggttgctccacttgttactgatatgcctctttcatcatcagttgaggatgaaacgggtgagggtggaaggactccgcaaccagcgtgggagaaatggtctaacgatgggactgaacgtcaagtggctaaactgatggaagagaacgttggagccgcgatgcagcttcttcaatcaaaggctctttgtatgatgccaatctcattggcaatggcaatttaccattctcaacctccggatacatcttcagtggtcaagcctgagaacaatcctccacagtaggatttctgcaataaagagtttgtacagctaatccaactgtccaacatgggtttttcttctgctctaatgactctggtttcttctctcctctctcacccacttgaaaggtaaaaaagtgaaaaaggctttgtagatggaatcaatgtaggatttgcagtagagggaaaaaaaatgtcaaaaagctcaattgatcaagtattattgtaatcattgtacctttattttaggtggactttgatgaaagcaactttttgttttcaagactttagtgggaggttgaggaaggagcttgaagggtgttatttattagtagtagtagtagtgggaagttgtgggaccttgttgagttgtgttcaaattgaagaaaaaacaagtatttgtaatttgtcaccccttgtattattatttattttgt

SEQ ID NO: 640 - protein, 310 aa, Arabidopsis thaliana
  misc_feature (1)..(310): Ceres CLONE ID no. 4346
  misc_feature (1)..(310): Also Known As Ceres GEMINI ID no. 534F8
  misc_feature (157)..(202): Pfam Name: HLH Pfam Description: Helix-loop-helix DNA-binding domain
MASNNPHDNLSDQTPSDDFFEQILGLPNFSASSAAGLSGVDGGLGGGAPPMMLQLGSGEEGSHMGGLGGSGPTGFHNQMFPLGLSLDQGKGPGFLRPEGGHGSGKRFSDDVVDNRCSSMKPVFHGQPMQQPPPSAPHQPTSIRPRVRARRGQATDPHSIAERLRRERIAERIRALQELVPTVNKTDRAAMIDEIVDYVKFLRLQVKVLSMSRLGGVGAVAPLVTDMPLSSSVEDETGEGGRTPQPAWEKWSNDGTERQVAKLMEENVGAAMQLLQSKALCMMPISLAMAIYHSQPPDTSSVVKPENNPPQ

SEQ ID NO: 641 - DNA, 968 bp, Arabidopsis thaliana
  misc_feature (1)..(968): Ceres CLONE ID no. 10976
  misc_feature (1)..(968): Also Known As Ceres GEMINI ID no. 553B5
atagaagaaagagctctgtccccaaaaacaaaggaaacaaaaaatcagtcggcgaaacgggaagagatctatcggaaatcttacggcggcggaagtcatggcgaacatagaatcagaagcagtcgatttcgagccagaggaggatgaccttatggacgaagaaggtacagctattgacggagctgatgtttctccacgcgcgggacatccgaggcttaagtcggctattgccggagctaatggcgaatcagcaaagaagaccaaaggccgtgggtttcgcgacgagaaagattccgatcgtcagcgtcgtctttcctcacgcgatttcgaatcacttggttcagatggccgtcctggtccgcagagatccgttgaaggatggattatcttggtctctggagttcatgaggagacacaggaggaggatataaccaatgcttttggtgattttggggagattaagaatctaaatctcaatctcgatcgccgtagtggttatgtcaagggatatgctttgatagaatatgagaagaaggaagaagcacagagcgctatttcagcaatgaatggtgctgagcttctaacacagaatgttagcgttgactgggccttcagcagcggtcccagtggtggtgaatcttacaggagaaagaactcgaggtatgggaggtcgcaacgttcaagaagtccgagaagacgttactgattgtatgatttggtggagagttctccccatatctctctgtattagggattccctctcttatctgtaaggtactgatgcaagacgctgagtgttgaacaaatttttttctggggtttttgtagggtttggctgcttttgcattggtttatctctttatgcatttgcatgggattgttgcgtttaaacaccatgagatctgttttaatgctttgtattggtaaacaaagagaaacattggatgaggaagaatgttttaattttc

SEQ ID NO: 642 - protein, 202 aa, Arabidopsis thaliana
  misc_feature (1)..(202): Ceres CLONE ID no. 10976
  misc_feature (1)..(202): Also Known As Ceres GEMINI ID no. 553B5
  misc_feature (97)..(168): Pfam Name: RRM_1 Pfam Description:
MANIESEAVDFEPEEDDLMDEEGTAIDGADVSPRAGHPRLKSAIAGANGESAKKTKGRGFRDEKDSDRQRRLSSRDFESLGSDGRPGPQRSVEGWIILVSGVHEETQEEDITNAFGDFGEIKNLNLNLDRRSGYVKGYALIEYEKKEEAQSAISAMNGAELLTQNVSVDWAFSSGPSGGESYRRKNSRYGRSQRSRSPRRRY

SEQ ID NO: 643 - protein, 191 aa, Arabidopsis thaliana
  misc_feature (1)..(191): Public GI no. 12325357
  misc_feature (1)..(191): Functional Homolog of  Ceres CLONE ID no. 10976 at SEQ ID NO. 642 with e-value of 7.60E-96 and percent identity of 98.9
MANIESEAVDFEPEEDDLMDEEGTAIDGADVSPRAGHPRLKSAIAGANGESAKKTKGRGFREEKDSDRQRRLSSRDFESLGSDGRPGPQRSVEGWIILVSGVHEETQEEDITNAFGDFGEIKNLNLNLDRRSGYVKGYALIEYEKKEEAQSAISAMNGAELLTQNVSVDWAFSSGPSGGESYRRKNSRFVS

SEQ ID NO: 644 - protein, 200 aa, Brassica napus
  misc_feature (1)..(200): Ceres CLONE ID no. 967560
  misc_feature (1)..(200): Functional Homolog of  Ceres CLONE ID no. 10976 at SEQ ID NO. 642 with e-value of 5.59E-84 and percent identity of 82.4
MANIEAEAVDFEPEEDDLMDEDVGASDLSPRAGHPRLRSAIAGANDESANRKTKGRGFREEKDSDRQRGLSSRDFESLGSDGGPGPQRSIEGWIVLVTGVHEEAQEDDISNAFGDFGEIKSLHLNLDRRTGFVKGYALIEYEKSEEAQSAIKAMNGAELLTKNVSVDWAFSNGPNNAGSYRRRNMRSGRSQRSRSPRRRF

SEQ ID NO: 645 - DNA, 669 bp, Populus balsamifera subsp. trichocarpa
  misc_feature (1)..(669): Ceres GDNA ANNOT ID no. 1439730
  misc_feature (1)..(669): Functional Homolog of  Ceres CLONE ID no. 10976 at SEQ ID NO. 642 with e-value of 1.60E-63 and percent identity of 70.5
atggcaaacacggaggccgaagcggtggattttgagccagaggaagatgatttgatggacgaagacggtgccgccgacgctgacgcctcctcctcacctcgtgctccactccccaagttaaagtcagctattactggaggcagcgcgtcttcttcactctccgctcctaaaaagactaaaggccgtgggtttagagaagaggttgatgctgagagacagagccgcctctctggtcgtggatttgattccctcggttctgatggtgggcctggcccccagcgatctgttgaaggatggataattttggtgagtggagtgcatgaggaagcacaagatgatcatctgcaagaagctttcggtgaatttggggaaataaaaaatttgcatttgaatcttgatcgccgcactggttttgttaagggctacgcgctgatagaatatgagaagtttgagcaagcagagaatgcaatagcttcaatgaatgggggaacattgctcgaacagattatctatgttgattgggccttcagcaatggccccagcaattgggcctccagaagaaagaacatgaggtctgtctctatgccgtacttttgtaagctgaaaattattggagatgatatattattagagagagaagatgtcagtgaaattaaatgtctctcctga

SEQ ID NO: 646 - protein, 222 aa, Populus balsamifera subsp. trichocarpa
  misc_feature (1)..(222): Ceres GDNA ANNOT ID no. 1439730
  misc_feature (1)..(222): Functional Homolog of  Ceres CLONE ID no. 10976 at SEQ ID NO. 642 with e-value of 1.60E-63 and percent identity of 70.5
MANTEAEAVDFEPEEDDLMDEDGAADADASSSPRAPLPKLKSAITGGSASSSLSAPKKTKGRGFREEVDAERQSRLSGRGFDSLGSDGGPGPQRSVEGWIILVSGVHEEAQDDHLQEAFGEFGEIKNLHLNLDRRTGFVKGYALIEYEKFEQAENAIASMNGGTLLEQIIYVDWAFSNGPSNWASRRKNMRSVSMPYFCKLKIIGDDILLEREDVSEIKCLS

SEQ ID NO: 647 - protein, 197 aa, Glycine max
  misc_feature (1)..(197): Ceres CLONE ID no. 626831
  misc_feature (1)..(197): Functional Homolog of  Ceres CLONE ID no. 10976 at SEQ ID NO. 642 with e-value of 9.80E-64 and percent identity of 69.1
MQGSAADGEALDFEPEDDDLMDEDGAPDADASPPQPKLKSAITAAAAPKKTKGRGFRQDTDANRDTRLSGSDFDSLTTEGGPGPQRSIEGWIILVTGVHEEAQEDDLQNAFGEYGEIKNLHLNLDRRTGFVKGYALIEYERAEEARNAIENLNGSELLTQTIYVDWAFSSGPINESVRRKNARPPRERRSRSPRRRY

SEQ ID NO: 648 - protein, 203 aa, Beta vulgaris
  misc_feature (1)..(203): Public GI no. 30524687
  misc_feature (1)..(203): Functional Homolog of  Ceres CLONE ID no. 10976 at SEQ ID NO. 642 with e-value of 5.19E-65 and percent identity of 68.3
MAAADVEAVDFEPEEDDLMDEDGGAAEADGSPRAPHPKIKSAITGAGAPSSGGFGAKKTKGRGFREDADAERNSRMTAREFDSLDSDGGPGPARSIEGWIILVTGVHEEAQEEDLLNVFGEFGQLKNLHLNLDRRTGFVKGYALIEYEKFEEAQAAIKEMNGAKMLEQPINVDWAFCNGPYRRRGNRRRSPRGHRSRSPRRRY

SEQ ID NO: 649 - protein, 195 aa, Solanum tuberosum
  misc_feature (1)..(195): Public GI no. 76573355
  misc_feature (1)..(195): Functional Homolog of  Ceres CLONE ID no. 10976 at SEQ ID NO. 642 with e-value of 9.99E-60 and percent identity of 66.4
MANAEVEAVDFEPEEDDLMDEDVDASSSPRATIPKLKSAITGGSSSAPKKTKGRGFREEAAEADRNARMSARFDSLDSEGGPGPERSIEGWIVLVTGVNEETQEDDLHNDFGEFGEIKNLHLNLDRRTGFVKGYAFIEYESFEEAQRAISEKDGAEFLTQTIHVAWAFSRGPFKRRNARRRSPHGHRSRSPRRRF

SEQ ID NO: 650 - protein, 209 aa, Triticum aestivum
  misc_feature (1)..(209): Public GI no. 68037220
  misc_feature (1)..(209): Functional Homolog of  Ceres CLONE ID no. 10976 at SEQ ID NO. 642 with e-value of 7.20E-52 and percent identity of 62.4
MAAAAMSTDVEAVDFDSDDDDLMDEEGAIEPSPAPAPRLRSTIAGGGGDDDDAPRKTKGRGFREDPNSSSAHRDSRLAGAGRSGFDALASDGGPGPVRSIEGWIVLVTGVHEEAQEEDLHNIFGDYGQVKNLHLNLDRRTGFVKGYALIEYENFEQAKRAIRESDGTELLSQIISVDWAFSNGPVNQRSTRKRSPRPNRSRSPPRRRYP

SEQ ID NO: 651 - protein, 209 aa, Triticum aestivum
  misc_feature (1)..(209): Ceres CLONE ID no. 615951
  misc_feature (1)..(209): Functional Homolog of  Ceres CLONE ID no. 10976 at SEQ ID NO. 642 with e-value of 3.50E-52 and percent identity of 61.6
MAAAAMNTDVEAVDFDSDDDDLMDEEGAIEPSPAPAPRLRSTIAGGGGGDDDAPRKTKGRGFREDPNSSSAHRDSRLAGAGRSGFDALASDGGPGPVRSIEGWIVLVTGVHEEAQEEDLHNIFGDYGQVKNLHLNLDRRTGFVKGYALIEYENFEQAKRAIRESDGTELLSQIISVDWAFSNGPVKQRSTRKRSPRPNRSRSPPRRRYP

SEQ ID NO: 652 - protein, 197 aa, Oryza sativa subsp. japonica
  misc_feature (1)..(197): Public GI no. 50540745
  misc_feature (1)..(197): Functional Homolog of  Ceres CLONE ID no. 10976 at SEQ ID NO. 642 with e-value of 1.19E-33 and percent identity of 52.8
MAAAAEDVEFVDYDRDEEEEEDAMDEDDRGGGRGGRALPVPHIVSQGVMRSRGRLLGRSTSVLASNRDRFDSLADAGNPGHGPQRSIEGWILLVSGVKEDAEEDDLYNTFSDFGHVKDLHLNLERRTGYAKGYALVEYESFEEAQTAIKAMNGTQLLTRTVYVDWAFSRGPIQKLTSTRPLHRRSRTPPRRLAALTC

SEQ ID NO: 653 - DNA, 861 bp, Arabidopsis thaliana
  misc_feature (1)..(861): Ceres CLONE ID no. 11615
  misc_feature (1)..(861): Also Known As Ceres GEMINI ID no. 535D4
aacatttcgtgcgaaatttcaattttttgcaatatcctttattgattgaccgaagatattttacaagcctttctccactaagcccttctctcttcttctcttggcctctcacttgaatctcccacaaagcgatcaatcacaaattccttcttctctctctttcttttcgtccccaagaatcaattatgaaaggagctaaatcaaagactgaaaccaggagctccaagctctctgtgaccaagaagccggctaaaggagcaggacgtggcaaagccgctgcgaaggaccccaacaaaccaaagaggccagccagtgctttcttcgtgttcatggaagatttccgtgagactttcaagaaggaaaaccccaagaacaagtctgtagctactgttggaaaagctgcaggagacaagtggaagtccttgtctgattctgagaaagctccatatgttgctaaggctgagaaacgcaaggttgaatatgagaagaacattaaagcttacaacaagaaactggaggaaggtccaaaggaagatgaggaatctgacaagtcagtgtcagaggtcaatgacgaggatgatgctgaggatggtagtgaagaggaggaggacgatgactaagaagctgaatgttggtagcattagtatagatggctgcaaaaatctctctgtttttatctttacttgaaatgttaacggggctgattaaaatgggtctttctttttatctttttatatttccacaatctctcacgaaagccctctgaatggagaaagtgaattgtagaatgtttagatggtgaaagagagacttgcagctctgtactctttgctttataaaacgatttagttttcttttccc

SEQ ID NO: 654 - protein, 144 aa, Arabidopsis thaliana
  misc_feature (1)..(144): Ceres CLONE ID no. 11615
  misc_feature (1)..(144): Also Known As Ceres GEMINI ID no. 535D4
  misc_feature (38)..(107): Pfam Name: HMG_box Pfam Description: HMG (high mobility group) box
MKGAKSKTETRSSKLSVTKKPAKGAGRGKAAAKDPNKPKRPASAFFVFMEDFRETFKKENPKNKSVATVGKAAGDKWKSLSDSEKAPYVAKAEKRKVEYEKNIKAYNKKLEEGPKEDEESDKSVSEVNDEDDAEDGSEEEEDDD

SEQ ID NO: 655 - DNA, 908 bp, Arabidopsis thaliana
  misc_feature (1)..(908): Ceres CLONE ID no. 16403
  misc_feature (1)..(908): Also Known As Ceres GEMINI ID no. 531F4
atcaaaagtcttgtgaattgtagccactatggcagtctcctcactctcaatccgctgtggtggtttctcaccaacaatctcccacaagacagaaattctctgtccaaatccatcactcaaagcttgttgtttactttcatccggtggtaaggccgactcctcggagagtacttaccaaaaaggcagcggaaacaattggaagagaaggcaagctcttgtgggagtaggaactttagtggcaacttcaattccagcaactttgcttcttgctgaagagataccaaaaagctactcgccttttgtggatcgagaagacgggtattcttactattacccatcagactggagggaatttgacttcagggcacatgattcagccttcaaagatagatacttgcaactgcagaatgtgcgggtcaggttcataccaacggagaaaaacgacatccatgaagtaggtcctatggaagaggtggtttatgatctagtgaagcataagtttgcagcaccaaaccaagtagctaccatctacgatatgaaagagagggtggaagatggaaagaactattacacgtttgagtatggactaagaactcctatctatgcaaccacttcctttgcaacagtggcagttggaaacaacagatactacactctcatagttggagcaaatgagagaaggtggaggaaagtgaaaaagcagcttcaagttgtggccgactctttgaagatccttcagatttgacaaacacaagaaacatcttactcctatatatctttctctctctgtggttacaaaactgtctgtagataacaatttgatattttcatattctctataactccaacgatggttttggcattgtgagttagattctgagttggttcagtaattcaatcaaacttgc

SEQ ID NO: 656 - protein, 238 aa, Arabidopsis thaliana
  misc_feature (1)..(238): Ceres CLONE ID no. 16403
  misc_feature (1)..(238): Also Known As Ceres GEMINI ID no. 531F4
  misc_feature (54)..(236): Pfam Name: PsbP Pfam Description:
MAVSSLSIRCGGFSPTISHKTEILCPNPSLKACCLLSSGGKADSSESTYQKGSGNNWKRRQALVGVGTLVATSIPATLLLAEEIPKSYSPFVDREDGYSYYYPSDWREFDFRAHDSAFKDRYLQLQNVRVRFIPTEKNDIHEVGPMEEVVYDLVKHKFAAPNQVATIYDMKERVEDGKNYYTFEYGLRTPIYATTSFATVAVGNNRYYTLIVGANERRWRKVKKQLQVVADSLKILQI

SEQ ID NO: 657 - protein, 235 aa, Gossypium hirsutum
  misc_feature (1)..(235): Ceres CLONE ID no. 1807796
  misc_feature (1)..(235): Functional Homolog of  Ceres CLONE ID no. 16403 at SEQ ID NO. 656 with e-value of 6.99E-70 and percent identity of 59.1
MAMNSVSLNWVPPSFTKKANYVTNSTELAPPSAFSSQNSLTYTKETISNEENNCKRRLLLLGVGVITANLLPANSLLAEEIPQNYRAFVDIPDGYSYYYPSDWREFDFRGHDSAFKDRFLQLQNVRVRFIPTDKQDIHELGPIEEVVYNLVNHVYAAPNQMVNILDMQERTSDGKNYYTFEYELTSPNYASASFATIAIGNGRYYTLVVGALERRWRRLRNKLKVVADSFKVLDI

SEQ ID NO: 658 - protein, 234 aa, Glycine max
  misc_feature (1)..(234): Ceres CLONE ID no. 611156
  misc_feature (1)..(234): Functional Homolog of  Ceres CLONE ID no. 16403 at SEQ ID NO. 656 with e-value of 8.29E-67 and percent identity of 58.9
MVVSSCSLSWISPCLSHKLNLPHTNCLPRNIATSSSNTVFCELDTTPSGESHCRRRPLLLGIGALTANLQPTNLVFAQEKPDRYRAFVDYEDGYSYVYPIDWKEFDFRAHDSAFKDRYLQLQNVRVRFIPTEKKDIRDLGPMEEVIYDLVKHRYAAPNQRPTINDMQEKTIDGKHYYTFEYILTSPNYSSASFATIAIGNGRYYTLIVGANERRWKRFRDQLKVVADSFRLLDI

SEQ ID NO: 659 - DNA, 699 bp, Populus balsamifera subsp. trichocarpa
  misc_feature (1)..(699): Ceres GDNA ANNOT ID no. 1464944
  misc_feature (1)..(699): Functional Homolog of  Ceres CLONE ID no. 16403 at SEQ ID NO. 656 with e-value of 4.99E-60 and percent identity of 56.2
atggcaatatcttcactctcattgagttgggcttccactaccttatcccaaaagttaagtgtccctggttcaaatgaaatattgcctagagtagcagcattttctggcaataactctgtaacatgcacggcagaggcaaccttcaatgaagaaagcaattgcaagagacgtctgctactgctaggagttggagcactaacgacaagtttagtcccagcaaatttcctttttgctgaagagataccaaagaactacacatcttttgtggactttgaagatgggtattcatattattacccctcagactggattgattttgacttcaggggacatgattctgcatttaaggacagaacgaagcaattgcagaatgttagggtgagatttataccaaccgagaaaaaagacattcatgaattgggtccaatggaagagtatgacagtcacatgcagcaagaaattatgaacgtgaaactttcaaattttcttgaaaaccagaaaaccgtagagggaaaaaactactacaccttcgagtacgaacttacatctccaaactactcaagtgtttcatttgcaaccatagttattgccaatgggagattttacactctgatagttggcgcaaatgaaagacggtggagaagatatcgcagtcagctaaaagtggtagcagactctttcaaggtgcttgacatctaa

SEQ ID NO: 660 - protein, 232 aa, Populus balsamifera subsp. trichocarpa
  misc_feature (1)..(232): Ceres GDNA ANNOT ID no. 1464944
  misc_feature (1)..(232): Functional Homolog of  Ceres CLONE ID no. 16403 at SEQ ID NO. 656 with e-value of 4.99E-60 and percent identity of 56.2
MAISSLSLSWASTTLSQKLSVPGSNEILPRVAAFSGNNSVTCTAEATFNEESNCKRRLLLLGVGALTTSLVPANFLFAEEIPKNYTSFVDFEDGYSYYYPSDWIDFDFRGHDSAFKDRTKQLQNVRVRFIPTEKKDIHELGPMEEYDSHMQQEIMNVKLSNFLENQKTVEGKNYYTFEYELTSPNYSSVSFATIVIANGRFYTLIVGANERRWRRYRSQLKVVADSFKVLDI

SEQ ID NO: 661 - protein, 232 aa, Panicum virgatum
  misc_feature (1)..(232): Ceres CLONE ID no. 1771837
  misc_feature (1)..(232): Functional Homolog of  Ceres CLONE ID no. 16403 at SEQ ID NO. 656 with e-value of 4.20E-56 and percent identity of 52.3
MASLQNLICSVSKQLVAPNFAVTAKLNGASHSVVPASSSGASSHEKNVTKRQLALLGAGALATGLLKTSSAFAEEVPKNYKSYVDAKDGYSYLYPAEWRDFDFLGHDSAFKDRNLALQCVRVGFIPTDKTDIRDLGPMDEAIFNLVNNVYAAPNQKPSIYDMQERTVDGKNYWTFEYDLEAPGYGVSAFATVAIGNGRYYTLIVTANERRWSRLRNRLKVVADSFKISDLTA

SEQ ID NO: 662 - DNA, 705 bp, Arabidopsis thaliana
  misc_feature (1)..(705): Ceres CLONE ID no. 16450
  misc_feature (1)..(705): Also Known As Ceres GEMINI ID no. 539C6
atttcacgactgatgtttttcttctccgacgctacaatcggtgtctgtttccgaagttgttcgttccattagagcttcagatttcgtcgtttggctgaagaaaatgttcatcaaagtgaaattgccatgggatgttacgattccagctgaagatatggacactggccttatgcttcagagagctattgtcattcgtctactcgaagccttttctaaagagaaagcaacaaaagatcttggatacttgataacaccgacaattcttgagaacatcggtgagggtaagatcaaggaacagaccggcgaaattcagtttcccgtagtttttaacggaatctgcttcaagatgtttaaaggagagattgttcatggtgtggtgcacaaggttcacaagactggtgtctttttgaaatctggcccttatgaaatcatttacctatcacacatgaaaatgcctggttacgagttcattccaggcgagaacccgtttttcatgaatcagtacatgtcccggattcaaatcggtgccagagttcgtttcgtcgtgttagataccgagtggagagaggcagagaaagacttcatggctttggctagcatcgatggagacaatcttggtccgttctaaaaagattgtaatcttaattttcactctatatatacatgttatgtaaaaacgctgttcaatgaaaatgatcaatcttt

SEQ ID NO: 663 - protein, 174 aa, Arabidopsis thaliana
  misc_feature (1)..(174): Ceres CLONE ID no. 16450
  misc_feature (1)..(174): Also Known As Ceres GEMINI ID no. 539C6
  misc_feature (1)..(80): Pfam Name: RNA_pol_Rpb7_N Pfam Description:
MFIKVKLPWDVTIPAEDMDTGLMLQRAIVIRLLEAFSKEKATKDLGYLITPTILENIGEGKIKEQTGEIQFPVVFNGICFKMFKGEIVHGVVHKVHKTGVFLKSGPYEIIYLSHMKMPGYEFIPGENPFFMNQYMSRIQIGARVRFVVLDTEWREAEKDFMALASIDGDNLGPF

SEQ ID NO: 664 - protein, 175 aa, Brassica napus
  misc_feature (1)..(175): Ceres CLONE ID no. 974460
  misc_feature (1)..(175): Functional Homolog of  Ceres CLONE ID no. 16450 at SEQ ID NO. 663 with e-value of 8.19E-60 and percent identity of 69.9
  misc_feature (175)..(175): Xaa is any aa, unknown, or other
MFIKVKLPSNVMIPAEAMDPNGLMIQRAVLIRLLDAFASKKATKDLGYFIALKNLEEIGEGRIRETTGEIIFPVVFSGITFKMFKGEIVHGVVRQVHKSGVFLRCGPCENVYLSQYKMPGYDYIVEGNPLFMNQNMSRIQIGSTVRFIVLDIQWKEAEKEFIALASLEGNNLGPX

SEQ ID NO: 665 - DNA, 614 bp, Arabidopsis thaliana
  misc_feature (1)..(614): Ceres CLONE ID no. 16473
  misc_feature (1)..(614): Also Known As Ceres GEMINI ID no. 539G3
aatcaccgccgctgagaccgccactttaggccgtctcctccgtaatctccgtaaccaacaccacccgcatcgcctgcgaattgatcggtgaggtggaagatggagttttgtcccacatgtgggaatctgttgcgctacgagggaggtgggagttcgagattcttctgttccacatgtccatacgttgcctacatcgaaagacgggtggagataaagaagaagcaacttctggttaagaaatctatagaacctgttgtgactaaagatgatatacccacagctgctgaaacagaagctccatgtccaaggtgtggccacgacaaggcgtacttcaaatcaatgcagattcgytcagcagatgagccagaatcaagattttatagatgcttgaagtgcgagttcacttggcgtgaggaatgaaccgatgatcatcaccttctctgtacccgctaattttgcaatcttctttgagtttgttttaccattacaaagtttgtagttcctctatgtactctggttctttctgtctcacagctcaagagtttctgtatttaaaagaatcgataaaattttggaatattgtgcaaagttttaatttttgaggtgaagaatgt

SEQ ID NO: 666 - protein, 106 aa, Arabidopsis thaliana
  misc_feature (1)..(106): Ceres CLONE ID no. 16473
  misc_feature (1)..(106): Also Known As Ceres GEMINI ID no. 539G3
  misc_feature (1)..(53): Pfam Name: RNA_POL_M_15KD Pfam Description:
  misc_feature (66)..(104): Pfam Name: TFIIS_C Pfam Description:
  misc_feature (84)..(84): Xaa is any aa, unknown, or other
MEFCPTCGNLLRYEGGGSSRFFCSTCPYVAYIERRVEIKKKQLLVKKSIEPVVTKDDIPTAAETEAPCPRCGHDKAYFKSMQIXSADEPESRFYRCLKCEFTWREE

SEQ ID NO: 667 - protein, 106 aa, Arabidopsis thaliana
  misc_feature (1)..(106): Ceres CLONE ID no. 9720
  misc_feature (1)..(106): Functional Homolog of  Ceres CLONE ID no. 16473 at SEQ ID NO. 666 with e-value of 4.89E-53 and percent identity of 95.2
MEFCPTCGNLLRYEGGGNSRFFCSTCPYVAYIQRQVEIKKKQLLVKKSIEAVVTKDDIPTAAETEAPCPRCGHDKAYFKSMQIRSADEPESRFYRCLKCEFTWREE

SEQ ID NO: 668 - protein, 103 aa, Brassica napus
  misc_feature (1)..(103): Ceres CLONE ID no. 1088401
  misc_feature (1)..(103): Functional Homolog of  Ceres CLONE ID no. 16473 at SEQ ID NO. 666 with e-value of 1.89E-44 and percent identity of 85.4
MEFCPTCGNLLRYGQSQFFCSTCPYIARIERQVEIKKKQLLVKKSIDAVVKKDDIPKGPETEAPCPRCGHDKAYFKTMQIRSADEPESRFYRCVKCEQTWREE

SEQ ID NO: 669 - protein, 111 aa, Glycine max
  misc_feature (1)..(111): Ceres CLONE ID no. 1121766
  misc_feature (1)..(111): Functional Homolog of  Ceres CLONE ID no. 16473 at SEQ ID NO. 666 with e-value of 4.29E-31 and percent identity of 62.8
MEFCPSCGNMLQYELPYMGRPSRFFCSACPYVCHIENRVEIKRKQRLVRKEIEPIFSEDDMTNAPSTEATCPFCGHGKAAFKEFQTRSADEPATLFYKCLNNDCKKQWREG

SEQ ID NO: 670 - DNA, 339 bp, Populus balsamifera subsp. trichocarpa
  misc_feature (1)..(339): Ceres GDNA ANNOT ID no. 1467514
  misc_feature (1)..(339): Functional Homolog of  Ceres CLONE ID no. 16473 at SEQ ID NO. 666 with e-value of 4.99E-28 and percent identity of 60.3
atggaattttgcccaacatgtgggatgctattgcgatatgagacgccaaatatggggcaagcagctagattttattgccctacctgtccctatttcgcttcgattgagagcagggttaagataaagagaaagcaaaagcttgctaagaaagaaattgaacctattttcaccctcgaggacatgaagacaggcggtgctgaaactgatgcaacatgtccccattgcaacttcggaagggcctgtttccagcagatacagattagatcagctgatgagccagcaacaacattttacttctgcttgaatgagaagtgtgggaggatgtggcgtgaggactga

SEQ ID NO: 671 - protein, 112 aa, Populus balsamifera subsp. trichocarpa
  misc_feature (1)..(112): Ceres GDNA ANNOT ID no. 1467514
  misc_feature (1)..(112): Functional Homolog of  Ceres CLONE ID no. 16473 at SEQ ID NO. 666 with e-value of 4.99E-28 and percent identity of 60.3
MEFCPTCGMLLRYETPNMGQAARFYCPTCPYFASIESRVKIKRKQKLAKKEIEPIFTLEDMKTGGAETDATCPHCNFGRACFQQIQIRSADEPATTFYFCLNEKCGRMWRED

SEQ ID NO: 672 - protein, 110 aa, Oryza sativa subsp. japonica
  misc_feature (1)..(110): Public GI no. 50251233
  misc_feature (1)..(110): Functional Homolog of  Ceres CLONE ID no. 16473 at SEQ ID NO. 666 with e-value of 1.40E-23 and percent identity of 50.9
MEFCPGCGMLLQIQPATGGNRLRFYCPTCPYVCPVKNKIVKKARLVKKEVEPIFSDSDAMKNAPKTTTTCPRCQNGEAYYRQMQIRSADEPMSTFYKCCREECQFDWRED

SEQ ID NO: 673 - DNA, 848 bp, Arabidopsis thaliana
  misc_feature (1)..(848): Ceres CLONE ID no. 21674
  misc_feature (1)..(848): Also Known As Ceres GEMINI ID no. 555G5
ataccacatattacactttttctccaatggcttctctgaagctttcaccttcttctccaatctccatttctaaggttggtgtgattccttcctctaagaaaggactttcatttcttgtaaaagcagagcaccattcctcgtcttcttcttctcatcttcaagataaatgtcagagacgtctgattgtaacatttggtgttgttgctccttggatctcattgcttagtagagctccattatcataaagcaaaaaaggattccttgctgtctctgacaataaagatgcttatgcgtttctctatccatttggttggcaggaagttgtgattgaaggtcaagataaggtatacaaagatgtgattgagcctttagaaagtgttaagtgtgaatttggtcccaactagcaaacagactattaaagaatttggccctcccaagcagatagctgaaacactgataaagaaagttttggcacctccaaatcagaaaacaacccttattgatgcatcagagcatgatgtcgatgggaagacttattatcagtttgagttcactgttcaagctagaaactacactcgtcatgctctgggtaccatcacggttttcaacggaaacttctacacactgacgacgggagcgaatgaaaggaggtgggagaagatgaaagataggcttcacactgtggtagattccttcaagatcactgtttgaaaatactgtaatcaagtttgctttggttgtctcttgttttgcccatttcttgtatttttgtccattcttcttctctctttcccttaacaatattcttttcctgtaagagagattcaataactcttgacttgcctccc

SEQ ID NO: 674 - protein, 72 aa, Arabidopsis thaliana
  misc_feature (1)..(72): Ceres CLONE ID no. 21674
  misc_feature (1)..(72): Also Known As Ceres GEMINI ID no. 555G5
MASLKLSPSSPISISKVGVIPSSKKGLSFLVKAEHHSSSSSSHLQDKCQRRLIVTFGVVAPWISLLSRAPLS

SEQ ID NO: 675 - DNA, 1345 bp, Arabidopsis thaliana
  misc_feature (1)..(1345): Ceres CLONE ID no. 21863
  misc_feature (1)..(1345): Also Known As Ceres GEMINI ID no. 553H9
  misc_feature (1)..(1345): Also Known As Ceres CDNA ID no. 23369680
  misc_feature (1)..(1345): Also Known As Ceres GEMINI ID no. 553H9
aaacctctctgtcattactctggtcagcgattcttctttcttcttcttctcagatcctttcaccgagtaagaagattttaaagatgccgtcaacgccgacgacgccgactacaacaacgccgatcacggcttcgtattggtgttacagctgtacgcgtttcgtcagcgtttgggctgatcaaggcacaacaaccgtcggtagcgtcgcttgccctcactgcgacggcggttttatcgaacagattaacgattcttcctccgccgctaccgaattaacgattccggcttctactgaagtaagatcgatcaataacaaccgtagatccgtgattagacgccggagatccggtcgtcgtccgtcctttaatccggtcatcgtacttcaaggaggcgccggcgagagagaagagggagaagaaggagatgcggctagagatcgacgcgcttttgagttttattacgatgacggatccggatcgggtcttagaccgcttccggattctgtatctgagatcttgatgggatctggattcgagcggttacttgaacagctaagccaaatcgaagcgtcggctactggaattggtagatctggaaaccctccggcgtctaaatcggcgattgagtctttacctagagtcgaaatctcggattgccacataggctcggaggctaattgcgctgtttgcacggagattttcgagacggagacggaggcgcgtgagatgccgtgtaaacaccttttccacgacgattgcatcgtaccgtggctatcgattcgaaactcttgtcccgtgtgcagattcgagctaccttaagagcctaatcgacggagcaacaacaacgaggaggataacgccgtggggatgacgatttggagacttcccggtggtggattcgccgtagggaggtttaacgcagcaatgagagacggagagagagttttgccagtggtgttaacagaaatggatggtggtgggattggtaatagccaggatggtcctagacggatctcatgggttaggtcacacggtacactcgaatcggatagtaacggtactggctcaggttccggctccggtggaagattgaggaggatggttcgtggaatggtgtcgttaatgaggagagtgagaccaaaccgtagctcttcttcttcatcagctgcgatatcaacttcttctgataatctggatttgaacattgaagtagaatctagggttttggataggtcaaattcagtgatgagaagatacttcagaagaaacagaagtaacagggattcttcgtcttcagttcttcattgattcagaaatatatatatatattattttttggtttgtcc

SEQ ID NO: 676 - protein, 244 aa, Arabidopsis thaliana
  misc_feature (1)..(244): Ceres CLONE ID no. 21863
  misc_feature (1)..(244): Also Known As Ceres CDNA ID no. 23369680
  misc_feature (1)..(244): Also Known As Ceres GEMINI ID no. 553H9
  misc_feature (1)..(244): Also Known As Ceres GEMINI ID no. 553H9
  misc_feature (199)..(239): Pfam Name: zf-C3HC4 Pfam Description:
MPSTPTTPTTTTPITASYWCYSCTRFVSVWADQGTTTVGSVACPHCDGGFIEQINDSSSAATELTIPASTEVRSINNNRRSVIRRRRSGRRPSFNPVIVLQGGAGEREEGEEGDAARDRRAFEFYYDDGSGSGLRPLPDSVSEILMGSGFERLLEQLSQIEASATGIGRSGNPPASKSAIESLPRVEISDCHIGSEANCAVCTEIFETETEAREMPCKHLFHDDCIVPWLSIRNSCPVCRFELP

SEQ ID NO: 677 - protein, 279 aa, Oryza sativa subsp. japonica
  misc_feature (1)..(279): Public GI no. 34902106
  misc_feature (1)..(279): Functional Homolog of  Ceres CLONE ID no. 21863 at SEQ ID NO. 676 with e-value of 7.09E-45 and percent identity of 63.4
MASSPVSYWCYHCSRFVRVSPSTVVCPECDGGFLEQFPQPPPRGGGGSGRRGAMNPVIVLRGGSLSGFELYYDDGSGDGLRPLPGDVSHLLMGSGFHRLLDQFSRLEAAAPRPPASKAAVESMPSVTVAGSGAHCAVCQEAFEPGASAREMPCKHVYHQDCILPWLSLRNSCPVCRRELPAAAAPESEADAGLTIWRLPRGGFAVGRFAGGPREQLPVVYTELDGGFSNGVGPRRVTWPEGDGHVDGGEGRIRRVFRNLFGCFGRSSRPESSSSQSRSG

SEQ ID NO: 678 - DNA, 1162 bp, Arabidopsis thaliana
  misc_feature (1)..(1162): Ceres CLONE ID no. 23733
  misc_feature (1)..(1162): Also Known As Ceres GEMINI ID no. 536C7
  misc_feature (619)..(619): n is a, c, t, g, unknown, or other
gttcatcgtctcttttgattttgattgtgcttctgcaacctttgatactctctctgaagctctgaggaagacatgatttcgtctctctcagcttcttcttcattggtttcttctttcgtcgccgttaaagcgactccggtcaccggacctctgattccccgtcgcgatcttctttctattcgtatcagagctagctcgaatcagaatagttctggttattgttttccagaaaagtttaaatcttttgccaaatcagcgattctcatcggtgctgctgtttcaatgaccggaaaattttcaactttaccggttaaagccgagtctccggttacgactatcgaaaagacctacgaggaagtgaaagaagagaaactgtctgagatcacgccattatctgagcttttggattccactcctgaggccgtcgagacgctgagatcactcctgcagcagaagctagagaagggagaagatgaagaagctcttaagctattagagagactagtagctgcacaaccagaagaaacagagtggaagttcttaatggcgaggctgttaggcgaaatgggtcgtcccgaaaacgcacgccagatgttcgaggaaattctccaaagaaacnccactttcgtttgaggctttattcgagaatgcattgctcatggacaggtccggggaaggaaatgcagtgctgcagaggctagaagatgctttagctgtagctgaggctgagtatttggtgaaggaagcgagagatgtgagactgatcattgcgcagatacatttcttgcagaagaatgtggatgaagcattgaagagctacgagcagctgacgaaagaggatcctaaggatttcagaccgtatttctgtcgaggtatgatctatagcttgcttgacaagaacgttgaagctaaggaacagtttgctaagtacagagagctctctccaaagaaatttgaagtagaagggtacttgaggactccattgtctaaaatgaagctttttggtggtagtgaggagaactaagttagtaagatagctttaaatcatatcagaagaataagacactggaagataatgttgttttcctgagaaattatgctgtgattttgctttgttgaattgaactttgaaactcaaccatttttggatcttgttttgttt

SEQ ID NO: 679 - protein, 186 aa, Arabidopsis thaliana
  misc_feature (1)..(186): Ceres CLONE ID no. 23733
  misc_feature (1)..(186): Also Known As Ceres GEMINI ID no. 536C7
  misc_feature (183)..(183): Xaa is any aa, unknown, or other
MISSLSASSSLVSSFVAVKATPVTGPLIPRRDLLSIRIRASSNQNSSGYCFPEKFKSFAKSAILIGAAVSMTGKFSTLPVKAESPVTTIEKTYEEVKEEKLSEITPLSELLDSTPEAVETLRSLLQQKLEKGEDEEALKLLERLVAAQPEETEWKFLMARLLGEMGRPENARQMFEEILQRNXTFV

SEQ ID NO: 680 - DNA, 615 bp, Arabidopsis thaliana
  misc_feature (1)..(615): Ceres CLONE ID no. 25571
  misc_feature (1)..(615): Also Known As Ceres GEMINI ID no. 531D2
gattcaccataaacaaaaagaatttgaaccaacaaagcaaaacatgaaaggcacattcactaacttgcttgtgctcctcctcattgcacttgtttgtgccaatgtcggtgctaggaaagttatctccgaagatacccaattcaaggatgaaaaatctttcctcggaggcagtggcagcggtgatggcttagggcttggccttggtggaggagctggtcttggtgggcttgggattggggctgggatcggcgcgggagccggactagggttaggtggaggcggtggtggactcggaggtggtggcggtggactcctcggtggaggcggctttgggggaggagccggtggcggactcggtggccttccttgaacgtattgacaagtgtgcgtgtgagagctgattctcagcttattactaattaattaagttactttcattctcttaataaaatctagagggtttgaatttcggatttcttcagctttaatttaaacttcaatatttgaaccaaaaaaggtcttagctactagaggtaatgctcgtaatcgtattatgtgtaacgccggttctgatattcttatgtgcaagtgtggaacgtttctcttttattcact

SEQ ID NO: 681 - protein, 108 aa, Arabidopsis thaliana
  misc_feature (1)..(108): Ceres CLONE ID no. 25571
  misc_feature (1)..(108): Also Known As Ceres GEMINI ID no. 531D2
MKGTFTNLLVLLLIALVCANVGARKVISEDTQFKDEKSFLGGSGSGDGLGLGLGGGAGLGGLGIGAGIGAGAGLGLGGGGGGLGGGGGGLLGGGGFGGGAGGGLGGLP

SEQ ID NO: 682 - protein, 93 aa, Arabidopsis thaliana
  misc_feature (1)..(93): Public GI no. 18391322
  misc_feature (1)..(93): Functional Homolog of  Ceres CLONE ID no. 25571 at SEQ ID NO. 681 with e-value of 8.69E-40 and percent identity of 97.8
MKGTFTNLLVLLLIALVCANVGARKLISEDTQFKDEKSFLGGGGSGDGLGLGLGGGAGLGGLGIGAGIGAGAGLGLGGGGFGGGAGGGLGGLP

SEQ ID NO: 683 - DNA, 625 bp, Arabidopsis thaliana
  misc_feature (1)..(625): Ceres CLONE ID no. 27175
  misc_feature (1)..(625): Also Known As Ceres GEMINI ID no. 533C5
attactcactcatacgctctctcgtcaaaccaaaaaaaaaaacctaaaagaaacttcgaaatgaaaggcggcgaatccaaagctgaagcaacgagcactgatcagagactcaaaaccagaggtagaaaggctgggaagaagacgaagaaggatccaaatcaacctaagagacctccaagtgctttcttcgtcttccttgaggatttccggaaagagtttaacctagcgaatcctaataacaaatccgtcgctactgttggtaaggctgctggagctagatggaagtcaatgactgatgaagataaagctccttacgtcgccaaggctgagagcagaaagactgaatatattaagaatgtgcaacagtacaacttgaaactggctagtggaaccaatagagaagaggatgactctgacaaatctaagtctgaggtggatgaagcagtaagcgaagaggaggcagaagacgacgattgaagcatctaggtcttgctattgacttgactcagatttgagaatgtaaacttgcttaggtttatgaccaaaaactttttaaatactcttatttatgctttgtgtttgtgatatttgaacctcatttgctacatcaatgttgttttaggcc

SEQ ID NO: 684 - protein, 138 aa, Arabidopsis thaliana
  misc_feature (1)..(138): Ceres CLONE ID no. 27175
  misc_feature (1)..(138): Also Known As Ceres GEMINI ID no. 533C5
  misc_feature (35)..(104): Pfam Name: HMG_box Pfam Description: HMG (high mobility group) box
MKGGESKAEATSTDQRLKTRGRKAGKKTKKDPNQPKRPPSAFFVFLEDFRKEFNLANPNNKSVATVGKAAGARWKSMTDEDKAPYVAKAESRKTEYIKNVQQYNLKLASGTNREEDDSDKSKSEVDEAVSEEEAEDDD

SEQ ID NO: 685 - DNA, 1456 bp, Arabidopsis thaliana
  misc_feature (1)..(1456): Ceres CLONE ID no. 33016
  misc_feature (1)..(1456): Also Known As Ceres GEMINI ID no. 553D4
aaagtttttcttcatttctctcttctctcttgtggtcaccgtttgatcggaatattccttttagaatgccaagattcattcttcatctctcgagctcctcatgaatttcttctctgcttatcaatggagatgatgagctcttcttcttctactactcaagttgtatcattcagagacatggggatgtatgaaccatttcaacagttatctggttgggagagtcctttcaaatcagatatcaacaatattactagtaatcagaataacaatcagagttcttcaacaacacttgagtttgatgctagaccagaagcagatgataacaatagagtgaattatacgtctgtgtataataactctcttgaagcagaaccgtcgagtaataatgatcaggacgaagaccggatcaatgataagatgaaacggcgtttggctcagaaccgagaagctgctcgcaaaagtcgtttgagaaagaaggcccatgttcaacagttagaagaaagccggttgaagttgtcacagctcgagcaggaacttgtaagagctaggcagcagggattatgcgtacgcaattcttcagatactagttatctaggaccagctgggaatatgaactcaggtattgctgcatttgagatggaatacacacactggctagaagagcaaaacaggagagttagtgagattcgaacagcgctccaagctcatataggtgacattgagctcaaaatgttggtagatagttgcttgaaccactacgcaaatctcttccgcatgaaagctgatgctgcaaaggctgatgtgttcttcttgatgtcgggaatgtggcgaacttcaactgaacgcttcttccaatggattggaggtttccgcccatccgagcttttaaatgttgtgatgccatacgttgagcccttaaccgatcagcaactgttggaggtgcgtaacctgcaacagtcgtctcagcaagcagaggaggctctctctcaaggcttagataaacttcagcagggtttggtcgaaagcatagcaattcagataaaagttgttgagtctgtgaatcacggggctccaatggcttcagccatggagaatcttcaagcattggagagttttgtgaaccaggcggatcatctgagacaacagactctgcagcaaatgagtaagatattgacgacaagacaggctgctcgagggttgctcgctctaggagaatacttccacaggctgcgtgctcttagttctctctgggcagctcgtccacgagaacacacttgacaagttaggaggcaaacaaaacaaagagaaagaagcacaaggcagatgatgttagctatagggacttgctttatctctcagaaagtgttggctgatattttctccattagagagcatcatcttcctcattgatgattttgtttacttgaaaggaataagagatgtgtaaatttgggtg

SEQ ID NO: 686 - protein, 384 aa, Arabidopsis thaliana
  misc_feature (1)..(384): Ceres CLONE ID no. 33016
  misc_feature (1)..(384): Also Known As Ceres GEMINI ID no. 553D4
  misc_feature (94)..(126): Pfam Name: bZIP_1 Pfam Description: bZIP transcription factor
MEMMSSSSSTTQVVSFRDMGMYEPFQQLSGWESPFKSDINNITSNQNNNQSSSTTLEFDARPEADDNNRVNYTSVYNNSLEAEPSSNNDQDEDRINDKMKRRLAQNREAARKSRLRKKAHVQQLEESRLKLSQLEQELVRARQQGLCVRNSSDTSYLGPAGNMNSGIAAFEMEYTHWLEEQNRRVSEIRTALQAHIGDIELKMLVDSCLNHYANLFRMKADAAKADVFFLMSGMWRTSTERFFQWIGGFRPSELLNVVMPYVEPLTDQQLLEVRNLQQSSQQAEEALSQGLDKLQQGLVESIAIQIKVVESVNHGAPMASAMENLQALESFVNQADHLRQQTLQQMSKILTTRQAARGLLALGEYFHRLRALSSLWAARPREHT

SEQ ID NO: 687 - DNA, 1036 bp, Arabidopsis thaliana
  misc_feature (1)..(1036): Ceres CLONE ID no. 34363
  misc_feature (1)..(1036): Also Known As Ceres GEMINI ID no. 538A10
ccgtcttcgttgctttttcgagcggtgcctagtctcaacttccatggctgacatcttaccttcaaattttctcaaaccaaccaaaaagcttcttctccttttctaaaatttcatcaaaccctatagggttttctcaatacaattgattttttttttcttcttcttctctatggatacgaccctttctcccgccgtggaggcggaacaaatcgccgactcaacgatcgacactgtttctcgtttgatcgccggcgttttctccggcgcacttactggaatcttcgctatggctggagcttttactggagctgtaactggtgcggtggcaggaagagctgcacagtatggagttctccgtggggctgcacttggcgctgttgctggagctatcctctctgttgaagtgttggaggcttctcgtgcgtattggtatttagagctgtcaggatcaaggggtccatcatctatggcagattttgtagagcaactgtttcgtgggagactggtagatgaacaacttatgtcaacaatcataaattcacaccattggcagttaaggatttccgatgtaagttatgaagagcgggaggatgtttatggtgaactggaagctagaggcttatcgggtgactctttaaggaaactaccatgctatataatgtcaagtgaaatggtcaggaggcaggtcactcactgcacaatttgtctgcaggacatcaaaacaggggaaatcacacgaagcttaccgaaatgtgatcatacgtttcatctggtatgtgttgataaatggctcatcagacacgggtcatgccccatttgcagacaggcagttaaagattaaaacacgactgttgccgagctgtgtacatagcaaaaacacattatccttatatgttgttgtaacttgtaagtctaaaacccctttcttctgtatttttcctcatttcatttagagcaatctcagcttgagccataggtttcgacttttgaatgtatattgttgtagacatgaataagaatacctacagatgtattg

SEQ ID NO: 688 - protein, 223 aa, Arabidopsis thaliana
  misc_feature (1)..(223): Ceres CLONE ID no. 34363
  misc_feature (1)..(223): Also Known As Ceres GEMINI ID no. 538A10
  misc_feature (176)..(217): Pfam Name: zf-C3HC4 Pfam Description:
MDTTLSPAVEAEQIADSTIDTVSRLIAGVFSGALTGIFAMAGAFTGAVTGAVAGRAAQYGVLRGAALGAVAGAILSVEVLEASRAYWYLELSGSRGPSSMADFVEQLFRGRLVDEQLMSTIINSHHWQLRISDVSYEEREDVYGELEARGLSGDSLRKLPCYIMSSEMVRRQVTHCTICLQDIKTGEITRSLPKCDHTFHLVCVDKWLIRHGSCPICRQAVKD

SEQ ID NO: 689 - DNA, 1504 bp, Arabidopsis thaliana
  misc_feature (1)..(1504): Ceres CLONE ID no. 34553
  misc_feature (1)..(1504): Also Known As Ceres GEMINI ID no. 531E5
atagccattttagttactctggtttgtttctcatcccattctctctctctttctctaatggttcttaatctgttttagcattttgatcatctaaaactttcaatttctctcttgatcctcacttgaattttttgttgtttctctcaaatctttgatcctttcctttgtttttcatttgacctcttacaaaaaaatctggtgtgccattaaatctttattaatggcacaacttcctccgaaaatcccaaccatgacgacgccaaattggcctgacttctcctcccagaaactcccttccatagccgcaacggcggcagccgcagcaaccgctggacctcaacaacaaaacccttcatggatggatgagtttctcgacttctcagcgactcgccgtgggactcaccgtcgttctataagcgactccattgctttccttgaaccaccttcctccggcgtcggaaaccaccacttcgataggtttgacgacgagcaattcatgtccatgttcaacgacgacgtacacaacaataaccacaatcatcatcatcatcacagcatcaacggcaatgtgggtcccacgcgttcatcctccaacacctscacgccgtccgatcataatagccttagcgacgacgacaacaacaaagaagcaccaccgtccgatcatgatcatcacatggacaataatgtagccaatcaaaacaacgcckycggtaacaattacaacgaatcasacgaggtccaaagccagtgcaagacggagccacargatggtccgtcggcgaatcaaaactccggtggaagctccggtaatcgtattcacgaccctaaaagggtaaaaagaattttagcaaataggcaatcagcacagagatcaagggtgaggaaattgcaatacatatcasagcttgaaaggagcgttacttcattgcagactgaagtgtcagtgttatcgccaagagttgcgtttttggatcatcagcgattgcttctcaacgtcgacaatagtgctatcaagcaacgaatcgcagctttagcacaagataagattttcaaagacgctcatcaagaagcattgaagagagaaatagagagacttcgacaagtatatcatcaacaaagcctcaagaagatggagaataatgtctccgatcaatctccggccgatatcaaaccgtccgttgagaaggaacagctcctcaatgtctaaagctgttcgttcactaagatctttcttttcatggcgaaaagattcttgactataaaacctctttgtgtcaagaaattaatttatcaaagaagatggccttttttatttgatctaatcacatttttttaagttgtgatgaatttgcttttgatgtatctgtttttttttttttttcttatggagtgggagggggaaagtgggaatgatatgtaaaaagaacttagctgatttgttgtttattcaatttttttgttggagtgtctatgcattgtgtactaattgatattttttccg

SEQ ID NO: 690 - protein, 329 aa, Arabidopsis thaliana
  misc_feature (1)..(329): Ceres CLONE ID no. 34553
  misc_feature (1)..(329): Also Known As Ceres GEMINI ID no. 531E5
  misc_feature (200)..(254): Pfam Name: bZIP_2 Pfam Description: Basic region leucine zipper
  misc_feature (127)..(127): Xaa is any aa, unknown, or other
  misc_feature (164)..(164): Xaa is any aa, unknown, or other
  misc_feature (172)..(172): Xaa is any aa, unknown, or other
  misc_feature (183)..(183): Xaa is any aa, unknown, or other
  misc_feature (229)..(229): Xaa is any aa, unknown, or other
MAQLPPKIPTMTTPNWPDFSSQKLPSIAATAAAAATAGPQQQNPSWMDEFLDFSATRRGTHRRSISDSIAFLEPPSSGVGNHHFDRFDDEQFMSMFNDDVHNNNHNHHHHHSINGNVGPTRSSSNTXTPSDHNSLSDDDNNKEAPPSDHDHHMDNNVANQNNAXGNNYNESXEVQSQCKTEPXDGPSANQNSGGSSGNRIHDPKRVKRILANRQSAQRSRVRKLQYISXLERSVTSLQTEVSVLSPRVAFLDHQRLLLNVDNSAIKQRIAALAQDKIFKDAHQEALKREIERLRQVYHQQSLKKMENNVSDQSPADIKPSVEKEQLLNV

SEQ ID NO: 691 - protein, 330 aa, Glycine max
  misc_feature (1)..(330): Ceres CLONE ID no. 463380
  misc_feature (1)..(330): Functional Homolog of  Ceres CLONE ID no. 34553 at SEQ ID NO. 690 with e-value of 3.69E-87 and percent identity of 69.6
MAQLPPKIPNMTPNWPDFSSLHQKMPSLQTTSSNQNPSWVDEILEFSVARRGAPRRSVSDSVTFLEAPLLDHHHCKGGSVVGGGGGNNEFERFDDEQFMSMFSDEASGNNNNNNTMMAHTLSSSNPSTPSDHNSINDEKEMENKEEEEKKQLKNESEDEDKSQCKQEITQLPNNDDSNNTSNANATCSSEKITDPKRVKRILANRQSAQRSRVRKLQYISELERSVTSLQAEVSVLSPRVAFLDHQRLLLNVDNSALKQRIAALAQDKIFKDAHQEALKREIERLRQVYHQQNIKKMDNNAAASPPSQSPSPSPKPRCETHTEKEQLINV

SEQ ID NO: 692 - DNA, 954 bp, Populus balsamifera subsp. trichocarpa
  misc_feature (1)..(954): Ceres GDNA ANNOT ID no. 1534144
  misc_feature (1)..(954): Functional Homolog of  Ceres CLONE ID no. 34553 at SEQ ID NO. 690 with e-value of 1.30E-77 and percent identity of 69.1
atggcacaattacctccgaaaataccaaacaatatgacaccgagttggcctgatttctctcataagaagtcaccttccatttgtattatggggacatcgccaccccacgatgctaatgcggtcattcctaccgttaccgctaacaccaccgctactgtcgcatcgcaaaacccttcgtgggttgatgaattcctcgacttctcgttgacgagacgtgggacgcaccggaggtcagtgagtgactccattgcattcctagaagaagcaccgacaatgctagaggaatgtcgttccacgggtgcaccgggattagggtcacggcattacagtagcagtgactttgacagatttgatgatgaacagtttatgtccatgtttaacgatggtatctcaaatgctgtggcagctcctaattcaagctccacaccttcttcgccgtctgatcataacagcattaatgacgagagagaagctacactgtctgagcaacagcaacagcagaaagtgagggatgagaatgatgaagggcaaaatctatctgaatgggagacaccaagtaccgtcccaagcgcaaccaatcctgctattacttctaatgaaaacaaaattgatcccaagagagttaagagaatcttggcaaacagacaatctgctcaaagatcacgagtgaggaaactgcagtacatatctgagcttgaacgtagtgtaacatcattgcaagctgaagtttctgtgttatcaccaagggttgcatatctagaccatcaaaggttgcttctaaatgttgacaacagtgctcttaagcaaagaatcgctgcactgtctcaagataagattttcaaagatgctcatcaagaagcattaaggacggaaatagagagactgaggcaagtttatcagcaacaaaacctcaagatggataaaacgaacagcagcatcaaccagaacaaatga

SEQ ID NO: 693 - protein, 317 aa, Populus balsamifera subsp. trichocarpa
  misc_feature (1)..(317): Ceres GDNA ANNOT ID no. 1534144
  misc_feature (1)..(317): Functional Homolog of  Ceres CLONE ID no. 34553 at SEQ ID NO. 690 with e-value of 1.30E-77 and percent identity of 69.1
MAQLPPKIPNNMTPSWPDFSHKKSPSICIMGTSPPHDANAVIPTVTANTTATVASQNPSWVDEFLDFSLTRRGTHRRSVSDSIAFLEEAPTMLEECRSTGAPGLGSRHYSSSDFDRFDDEQFMSMFNDGISNAVAAPNSSSTPSSPSDHNSINDEREATLSEQQQQQKVRDENDEGQNLSEWETPSTVPSATNPAITSNENKIDPKRVKRILANRQSAQRSRVRKLQYISELERSVTSLQAEVSVLSPRVAYLDHQRLLLNVDNSALKQRIAALSQDKIFKDAHQEALRTEIERLRQVYQQQNLKMDKTNSSINQNK

SEQ ID NO: 694 - protein, 287 aa, Oryza sativa subsp. japonica
  misc_feature (1)..(287): Public GI no. 34903896
  misc_feature (1)..(287): Functional Homolog of  Ceres CLONE ID no. 34553 at SEQ ID NO. 690 with e-value of 2.19E-66 and percent identity of 64.9
MGAFLAAPLPPFPLPPPAPANGGAQQQQQQQQHQPSWVDEFLDFSATKRGAHRRSVSDSVAFLDPVSDDNAGVGAHDFDRLDDDQLMSMFSDDLQPPPPQQQPAAPAASASSPSDHNSMNDEKQDKGETDEAQSECDGATPGQPASPATVDPKRVKRILANRQSAQRSRVRKLQYISELERSVTSLQTEVSALSPRVAFLDHQRSLLTLGNSHLKQRIAALAQDKIFKDAHQEALKKEIERLRQIYHQQSLKNAESQPADAAPVRGRDNADLIGSEGAAAAAPCPHS

SEQ ID NO: 695 - DNA, 939 bp, Populus balsamifera subsp. trichocarpa
  misc_feature (1)..(939): Ceres GDNA ANNOT ID no. 1479838
  misc_feature (1)..(939): Functional Homolog of  Ceres CLONE ID no. 34553 at SEQ ID NO. 690 with e-value of 9.80E-64 and percent identity of 64.6
atggcacaattacctccaaaaataccaaacgtgacaccaagttggcccgatttttctcataaaaaattaccaataattggcattatggagacatcaccaccccgtgatgctaatatcatcaccgccattgttacaaacccttcgtgggttgacgaatttctcggcttctcgtcgacgagacgtgggacacataggaggtcggtgagtgactccattgcattccgggaagaagcaccaacgatgttagagaaatgtcgtgccacgggtgcaccgggattagggtcgggacataacagcagcactgactttgacaagtttgatgatgaacagcttatgtccatgtttaacgatgatatctccaatgccgtggcagctcctaattctagctccacaccttcttcgccgtctgatcacaacagcattaatgatgagaaagaagctatagtagtggcgtctaagcataagcagcagcagaaggtgaggaatgagaatgatgaagggcaaagtccatctgaatgggagacaccgactactgtcccaactgccaccgatcctgctgctacttctaatgaacggaaaatcgatcccaggagagttaagagaatcttggcaaacagacaatctgctcaaagatcacgggtgagaaagctgcagtacatatctgagcttgaacgctgtgtaacatcattgcaaggtgaagtttcagtgttgtcaccaagggttgcatatctagaccatcgaaggttgcttctaaatgttgacaacagtgctcttaagcaaagaatcgctgcactggctcaagataagattttcaaagatggcaactcatcaagaagcattgaagagggaaatagagaggctaaggcaagtgtatcatcaacagaacctcaagatggaaaatacttcaccaccatcagcatcatcaaccccatcaaatga

SEQ ID NO: 696 - protein, 312 aa, Populus balsamifera subsp. trichocarpa
  misc_feature (1)..(312): Ceres GDNA ANNOT ID no. 1479838
  misc_feature (1)..(312): Functional Homolog of  Ceres CLONE ID no. 34553 at SEQ ID NO. 690 with e-value of 9.80E-64 and percent identity of 64.6
MAQLPPKIPNVTPSWPDFSHKKLPIIGIMETSPPRDANIITAIVTNPSWVDEFLGFSSTRRGTHRRSVSDSIAFREEAPTMLEKCRATGAPGLGSGHNSSTDFDKFDDEQLMSMFNDDISNAVAAPNSSSTPSSPSDHNSINDEKEAIVVASKHKQQQKVRNENDEGQSPSEWETPTTVPTATDPAATSNERKIDPRRVKRILANRQSAQRSRVRKLQYISELERCVTSLQGEVSVLSPRVAYLDHRRLLLNVDNSALKQRIAALAQDKIFKDGNSSRSIEEGNREAKASVSSTEPQDGKYFTTISIINPIK

SEQ ID NO: 697 - protein, 328 aa, Medicago truncatula
  misc_feature (1)..(328): Public GI no. 92871553
  misc_feature (1)..(328): Functional Homolog of  Ceres CLONE ID no. 34553 at SEQ ID NO. 690 with e-value of 7.89E-78 and percent identity of 60.5
MAQLPPKVPIPNMTPTWPEFSSHQKMPNLKTISPSNASNFSNNQQNPSWVDEFLDFSSTRRGAHRRSASDSVTFIEASMMEHCRRRDGDNEFERFDDEQLMSMFSVDEVSRNNTMMPPPATLSSNSNPSTPSDHNSINDEKEEDEEEKMQQKQLKHESDEDEIGECKQENGGVVNDEDDNNGNTTTFSSPKITDPKRVKRILANRQSAQRSRVRKLQYISELERSVTSLQAEVSVLSPRVAYLDHQRLLLNVDNSAIKQRIAALAQDKIFKDAHQEALKREIERLRQVYHQQQNIKNNATAAAVSPSPSPKPRCDNDTHIENEHLINV

SEQ ID NO: 698 - DNA, 1062 bp, Arabidopsis thaliana
  misc_feature (1)..(1062): Ceres CLONE ID no. 35890
  misc_feature (1)..(1062): Also Known As Ceres GEMINI ID no. 535A8
aaggaataaacttcgtgaagagaaatgactctagaagctttatcatcaaacggtcttttaaactttttgctctctgaaactctttcaccaactccattcaagtctctcgtcgatctcgagccattgccggaaaatgatgtcatcatatcgaagaacacaatttcggagatatctcatcaagaaccgccaccacagcgacaaccaccagctacgaatcaagggaagaagcggcggaggaggaagcctagggtttgcaaaaacgaggaagaagctgagaatcaacgaatgactcacattgccgtcgaaagaaatcgaagaagacaaatgaatcaacatctctctgtcttgcgatctctcatgcctcaaccttttgctcacaagggtgatcaagcttcaatagttggtggagccatagatttcatcaaagaacttgaacacaaattactatctcttgaagctcaaaaacatcataatgctaaattaaaccagtcggttacttcttcaacaagtcaagacacaaatggtgaacaagagaatcctcatcaaccatcttcactatctctatcgcagttctttcttcattcatacgatccgagccaagagaataggaacggctcaacaagctcggtgaaaacccctatggaagatcttgaggtgactctaatcgaaactcatgctaacatcagaatcttgtcgagaagaagaggtttccggtggagcacgttggccaccaccaaaccgccgcagctttcgaagctggtggcttctctacaatcgctgtccctctccattcttcaccttagtgtcacaacattggacaattatgctatttactccatcagcgctaaggtggaagagagttgccagctaagttcagtagatgacattgcaggagcagttcaccacatgctaagtatcattgaagaggagcctttttgttgctcatcaatgtcagaattaccatttgacttctctttgaatcactcaaatgtcactcattctctctgagaaatctcttttttgttattgttgttccttcttttaattttatcacatagcacc

SEQ ID NO: 699 - protein, 327 aa, Arabidopsis thaliana
  misc_feature (1)..(327): Ceres CLONE ID no. 35890
  misc_feature (1)..(327): Also Known As Ceres GEMINI ID no. 535A8
  misc_feature (86)..(137): Pfam Name: HLH Pfam Description: Helix-loop-helix DNA-binding domain
MTLEALSSNGLLNFLLSETLSPTPFKSLVDLEPLPENDVIISKNTISEISHQEPPPQRQPPATNQGKKRRRRKPRVCKNEEEAENQRMTHIAVERNRRRQMNQHLSVLRSLMPQPFAHKGDQASIVGGAIDFIKELEHKLLSLEAQKHHNAKLNQSVTSSTSQDTNGEQENPHQPSSLSLSQFFLHSYDPSQENRNGSTSSVKTPMEDLEVTLIETHANIRILSRRRGFRWSTLATTKPPQLSKLVASLQSLSLSILHLSVTTLDNYAIYSISAKVEESCQLSSVDDIAGAVHHMLSIIEEEPFCCSSMSELPFDFSLNHSNVTHSL

SEQ ID NO: 700 - DNA, 1204 bp, Arabidopsis thaliana
  misc_feature (1)..(1204): Ceres CLONE ID no. 36399
  misc_feature (1)..(1204): Also Known As Ceres GEMINI ID no. 554F7
ggcaaaaagcaaagagagagagagagagaagaagaagtgagacttgtgttcttacggtgtttatagcttctttgttttgtcttttaggttcttgcctttttccgatcaatcagaccaatccctccttcacttttagcatcttattctctttcgttcttcttatatttctgggaattttcttcaatcgattcctctttgttgtaatctcacaattagagagagagatatgtataatcagttggcgatatcttcgtcttcttcatcttcttcgtactatgaatctttgaaggttttggaagctgatgttcaacacgctaattctttggcagaagcaattccaatggggaagaacaatgtgcggcttcagatgaaactggttcatagtaactttgcttcattattactcttcttgcttcggtggattgatctttcttcctcatgtcttattcctcgctacttaaacctctttcatgttcttgtctacaaggtccagtctgatggacaacctaagcttaccacgcacggaaggaaagcaacgattagtgagttctatggtgtgatactaccatcactgcagctattacacagcaacttagatgagttggaaaccacagacatcgggtttgaccttaaaagactcagtaagaagataacaaaagaggctcgtagtagtagattcagcaatgccggtttagagcgtgaagaagaatgcggtatctgtttagaaacttgcaccaaaatggtgttgcctaattgttgccattctatgtgcatcaaatgctatcgcaattggaacttgaagtctcagtcatgcccgttttgtcgaggcagcatgaagagagtgaactcagaggacttgtgggtgcttgcgggtgataacgatgtggtggatacaaggacggcttcaagggaagatttgttcagattctatctctacatcaatagccttcccaaggattacccagaagctctctttgtggtttactatgagtactcaaatctgctatagaatctggacaaacaaaactttgtacagatttttagatggtaaatgtattgtatagaatgtaaaactgtgttaaggcttttggatgatatgatgcaaatgccaaagctctcagtttttacatacttaataattgtcaaattgcgagaaaaaaaaaaagcttgaatgcagcaaagaataaagatctcatttcatctc

SEQ ID NO: 701 - protein, 260 aa, Arabidopsis thaliana
  misc_feature (1)..(260): Ceres CLONE ID no. 36399
  misc_feature (1)..(260): Also Known As Ceres GEMINI ID no. 554F7
  misc_feature (162)..(199): Pfam Name: zf-C3HC4 Pfam Description:
MYNQLAISSSSSSSSYYESLKVLEADVQHANSLAEAIPMGKNNVRLQMKLVHSNFASLLLFLLRWIDLSSSCLIPRYLNLFHVLVYKVQSDGQPKLTTHGRKATISEFYGVILPSLQLLHSNLDELETTDIGFDLKRLSKKITKEARSSRFSNAGLEREEECGICLETCTKMVLPNCCHSMCIKCYRNWNLKSQSCPFCRGSMKRVNSEDLWVLAGDNDVVDTRTASREDLFRFYLYINSLPKDYPEALFVVYYEYSNLL

SEQ ID NO: 702 - DNA, 1394 bp, Arabidopsis thaliana
  misc_feature (1)..(1394): Ceres CLONE ID no. 37859
  misc_feature (1)..(1394): Also Known As Ceres GEMINI ID no. 554G7
aaagatgaaaagtaatacccttcctctcttgccctttttgctggtctgggtgaaacatagaaaagtttctcttgctcaagttaatgataaaaggttgttgtaggatttgttgctctggctctggtggtaggtctatgaaatcaacccatatcgtgaatggactgcaacatggtatcttcgtcccagtgggattgggagcatttgatcatgtccaatccgtcaaggactgaagatgacagcaaacagctacctactgagtgggaaattgaaaaaggtgaaggaattgaatctatagttccacatttctcaggccttgagagagtcagtagtggctctgccaccagcttctggcacactgctgtatcgaaaagctcacagtcgacctctatcaactcatcatctcccgaagccaaacgatgcaagcttgcatcagaaagttcccctggagattcttgcagcaacatagactttgtccaggtgaaggctcccacagctctcgaggtatccgttgcctcagctgaatcagatctttgtttaaaactaggaaagcggacatactctgaagaatactggggtagaaacaataatgaaatttcagcggtttctatgaagttgttaactccatctgttgtcgctgggaaatccaaattgtgtggtcagagcatgccagtcccgcgttgccaaattgatggctgtgaactggatctctcatctgctaagggttatcatcgtaagcacaaagtctgcgaaaagcattcaaagtgcccaaaagttagcgtgagtggcctggaacgtcggttctgccaacagtgtagcaggttccatgctgtctctgaatttgatgagaagaaacgaagctgccgaaaacgtctttctcatcataatgcgaggcgtcgtaagccacaaggagtattttcaatgaatcccgagagggtgtatgatcgaagacagcatacaaatatgttgtggaatggggtgtcccttaacgcgagatctgaagaaatgtatgaatggggtaataacacttatgatacaaagcctagacaaacggaaaaaagctttactctgagcttccakagaggtaatggctctgaggaccagctggttgctagtarcagccgtwtgttctctacatctcaaacctcaggtgggttcccagcwssaaagtccaagtttcaacttcatggcgaasatgtgggagaatactcaggagtcctccatgaatctcaagatatccaccgtgctctctctyttctgtcaacctcttcggatcccctggcccaaccacatgtgcagccattttctctactctgttcatatgatgttgtaccaaaatagatgagtaagtaatgtgtaatttgtaaacctgttactcagtaggtggatacttttcc

SEQ ID NO: 703 - protein, 393 aa, Arabidopsis thaliana
  misc_feature (1)..(393): Ceres CLONE ID no. 37859
  misc_feature (1)..(393): Also Known As Ceres GEMINI ID no. 554G7
  misc_feature (174)..(252): Pfam Name: SBP Pfam Description:
  misc_feature (307)..(307): Xaa is any aa, unknown, or other
  misc_feature (320)..(320): Xaa is any aa, unknown, or other
  misc_feature (323)..(323): Xaa is any aa, unknown, or other
  misc_feature (335)..(335): Xaa is any aa, unknown, or other
  misc_feature (336)..(336): Xaa is any aa, unknown, or other
  misc_feature (346)..(346): Xaa is any aa, unknown, or other
  misc_feature (366)..(366): Xaa is any aa, unknown, or other
MDCNMVSSSQWDWEHLIMSNPSRTEDDSKQLPTEWEIEKGEGIESIVPHFSGLERVSSGSATSFWHTAVSKSSQSTSINSSSPEAKRCKLASESSPGDSCSNIDFVQVKAPTALEVSVASAESDLCLKLGKRTYSEEYWGRNNNEISAVSMKLLTPSVVAGKSKLCGQSMPVPRCQIDGCELDLSSAKGYHRKHKVCEKHSKCPKVSVSGLERRFCQQCSRFHAVSEFDEKKRSCRKRLSHHNARRRKPQGVFSMNPERVYDRRQHTNMLWNGVSLNARSEEMYEWGNNTYDTKPRQTEKSFTLSFXRGNGSEDQLVASXSRXFSTSQTSGGFPXXKSKFQLHGEXVGEYSGVLHESQDIHRALSXLSTSSDPLAQPHVQPFSLLCSYDVVPK

SEQ ID NO: 704 - DNA, 1326 bp, Arabidopsis thaliana
  misc_feature (1)..(1326): Ceres CLONE ID no. 38858
  misc_feature (1)..(1326): Also Known As Ceres GEMINI ID no. 555G2
cttctcgcatcttatatgaaacacattcactctccaaaataatctatacttttcctacatattctcttgacgatcatgagactcatttcgtgaaaatatcgtcattatatcaaattagaagttgatggaaaacatgggggattcgagcatagggccgggccatccgcatctccctcccgggtttcggtttcacccgactgatgaggaactagtagttcattacctcaagaagaaagcagcttctgttccacttccagtctcaatcatcgcagagattgatctttacaagtttgatccttgggagcttccaagcaaggcgagttttggagagcacgagtggtacttctttagtcctcgggatcggaagtatccaaatggggttaggccaaaccgggcagcaacttccggttattggaaagcaacgggaaccgataaaccgatatttacgtgcaatagtcacaaggttggtgtcaagaaagcgcttgttttttacggtggaaagcctcctaaagggataaaaacagattggatcatgcatgaatatcgcctcactgatggtaaccttagcactgcggctaagccgcctgacttaaccacgacaaggaaaaactcactacggctagacgattgggttctatgtaggatctataagaagaatagttcacaaasgaccacacaatggagagagtattagagaggatctaatggaaggcatgctctcaaaatcatctgctaattcttcttctacatcagtactagacaacaacgacaacaataatracaataacaaagaacactttttcgacggtatggtcgtttcttcagacaaacgttccttgtgtggtcaataccgaatgggcgacgaggcctcaggatcatcttcattcggatctttcttatcgagcaagaggtttcatcatacaggtgatctcaacaatgataactacaatgtctcttttgtttcgatgcttagtgagattcctcagagttcggggtttcatgcaaatggtgttatggatacgacgtcgtctctagctgatcatggggttttaagacaggcgtttcagcttcctaacatgaactggcactcataatctatatagatatatatgtatgtatcatatatgtatctatgcaggcctaatatagtttacacataaatcatctgggaatatatatatacaagtacgcggtcttacaaatgtatacgtatctgtttaattacgtcaagaaaaagtgtatacgtttctttttactcaatggctgcaaagatgtgtactaataacagaagctgattaataaaaaatataaaagtatattttttcc

SEQ ID NO: 705 - protein, 189 aa, Arabidopsis thaliana
  misc_feature (1)..(189): Ceres CLONE ID no. 38858
  misc_feature (1)..(189): Also Known As Ceres GEMINI ID no. 555G2
  misc_feature (16)..(143): Pfam Name: NAM Pfam Description: No apical meristem (NAM) protein
  misc_feature (182)..(182): Xaa is any aa, unknown, or other
MENMGDSSIGPGHPHLPPGFRFHPTDEELVVHYLKKKAASVPLPVSIIAEIDLYKFDPWELPSKASFGEHEWYFFSPRDRKYPNGVRPNRAATSGYWKATGTDKPIFTCNSHKVGVKKALVFYGGKPPKGIKTDWIMHEYRLTDGNLSTAAKPPDLTTTRKNSLRLDDWVLCRIYKKNSSQXTTQWREY

SEQ ID NO: 706 - DNA, 1497 bp, Arabidopsis thaliana
  misc_feature (1)..(1497): Ceres CLONE ID no. 40196
  misc_feature (1)..(1497): Also Known As Ceres GEMINI ID no. 555D4
gacggcccgacctcgattctcttccacttctttcttgttccaaaaacctaaaccctctctctctctctctctctctctctatctcttgaaaaatcaacaaaacattggaatcaatttctctatgttttgattctattttaaagatccaatattctttctccattgagattaagcttctttctcgttgtcgtctctctatagatcttggttcttagtcccttttgaataataatgatggtggagatggattacgctaagaaaatgcagaaatgtcatgaatacgttgaagcacttgaagaagaacagaagaaaatccaagtctttcaacgcgagcttcctttatgtttagagcttgtcactcaagcgatcgaagcttgtcggaaggagttatctggtacgacgacaactacatcagaacagtgttcagaacagaccacaagtgtttgtggtggtcctgtctttgaagagtttattcctatcaagaaaattagttccttgtgtgaagaagtacaagaagaagaagaagaagatggtgaacatgaatcttctccagaacttgtgaataataagaaatcagattggcttagatctgttcagctatggaatcattcaccggatctaaatccaaaagaggagcgtgtagctaagaaagcgaaagtggtggaggtgaaaccaaaaagcggtgcgtttcagccatttcaaaagcgcgttttggagactgatttgcaaccggcggtgaaagtagctagttcgatgccagcgacgacgacgagttctacgacggaaacttgtggtggtaaaagtgatttgattaaagctggagatgaggaaagacggatagagcagcagcaatcgcagtcgcatacgcatagaaaacaaaggcggtgctggtcgccggaattacaccgtcgattcctaaacgcgcttcagcagcttggaggatctcatgttgctacaccaaagcaaatcagggatcacatgaaggttgatggattaacaaacgacgaagttaaaagccatttacagaaatatagacttcacacaagaaggccagcagcaacatccgtggcggcacaaagtaccgggaatcagcaacaaccacaatttgtggtggttggaggcatatgggtaccatcgtcacaagattttccaccaccgtccgatgtagccaacaagggtggtgtatatgctccggttgcggtggcgcaatctccaaaacgttcgttggagagaagttgcaactcgccggcggcatcttcctctacaaatacaaatacttctactcctgtgtcatagtctgatagtcatactagaatcatctcctgatgttgattttagtgcaggtttgaaaatgtttatgtgaatgtaagatatattttcgtccgtttttgtttgtaaccaagaaatgttatttcctcggttggaaattttgaataaagtagacgaatgctactatgtagtatatacacgagataagtgaagactctttgtttttct

SEQ ID NO: 707 - protein, 354 aa, Arabidopsis thaliana
  misc_feature (1)..(354): Ceres CLONE ID no. 40196
  misc_feature (1)..(354): Also Known As Ceres GEMINI ID no. 555D4
  misc_feature (217)..(268): Pfam Name: Myb_DNA-binding Pfam Description: Myb-like DNA-binding domain
MMVEMDYAKKMQKCHEYVEALEEEQKKIQVFQRELPLCLELVTQAIEACRKELSGTTTTTSEQCSEQTTSVCGGPVFEEFIPIKKISSLCEEVQEEEEEDGEHESSPELVNNKKSDWLRSVQLWNHSPDLNPKEERVAKKAKVVEVKPKSGAFQPFQKRVLETDLQPAVKVASSMPATTTSSTTETCGGKSDLIKAGDEERRIEQQQSQSHTHRKQRRCWSPELHRRFLNALQQLGGSHVATPKQIRDHMKVDGLTNDEVKSHLQKYRLHTRRPAATSVAAQSTGNQQQPQFVVVGGIWVPSSQDFPPPSDVANKGGVYAPVAVAQSPKRSLERSCNSPAASSSTNTNTSTPVS

SEQ ID NO: 708 - protein, 379 aa, Glycine max
  misc_feature (1)..(379): Ceres CLONE ID no. 467905
  misc_feature (1)..(379): Functional Homolog of  Ceres CLONE ID no. 40196 at SEQ ID NO. 707 with e-value of 2.09E-68 and percent identity of 51.3
MQFAQKMQPLKMGFLQYIEALEEERRKIQVFPKELPLSLELVTQAIEACRQQLAGTVAEYNLNGQSECSEQTSTDGPVFEEFIPLKKRASQDSVEEEDEDEEHFHKHKKTATDKKKSDWLRSVQLWNPNPPPTKEDVVVPRKTDVVEVKRNGGAFQPFQREEKSGDAKASINNDASAIGKAPSSPPVPATSSTGPVRVENKKEEKGQAQRKQRRCWSQELHKRFLHALQQLGGADSATPKQIRELMKVDGLTNDEVKSHLQKFRLHTRRSPIIHNNASSQAGPLFLVGNIFVQPPEYAAVATTSTASGEELTTVTTTTAPTGIYAPVAAHPPAVTHTLPIMKQKEHSHSEERPNHSVLSNSPASSSSTHTITTSPPVPN

SEQ ID NO: 709 - DNA, 1077 bp, Arabidopsis thaliana
  misc_feature (1)..(1077): Ceres CLONE ID no. 42533
  misc_feature (1)..(1077): Also Known As Ceres GEMINI ID no. 535A7
atcttctatctctcaaaagaaaagcagacaactttatttgcaaaacagagtttttttttcttttcttgagaaagttcaacagaagatgatgttggagaaagacgatctgggtctaagcttaggcttgaattttccaaagaaacagatcaatctcaaatcaaatccatctgtttctgttactccttcttcttcttcttttggattattcagaagatcttcatggaacgagagttttacttcttcagttccaaactcagattcgtcacaaaaagaaacaagaactttcatccgaggaatcgacgtgaacagaccaccgtctacagcggaatacggcgacgaagacgctggagtatcttcacctaacagtacaatctcaagctctacagggaaaagaagcgagagagaagaagacacagatccacaaggctcaagaggaatcagtgacgatgaagatggtgataactccaggaaaaagcttagactttccaaagatcaatctgctattcttgaagagaccttcaaagatcacagtactctcaatccgaagcagaagcaagcattggctaaacaattagggttaagagcaagacaagtggaagtttggtttcagaacagacgagcaagaacaaagctgaagcaaacggaggtagactgtgagttcttacggagatgctgcgagaatctaacggaagaaaaccgtcggctacaaaaagaagtaacggagttgagagcacttaagctctctcctcagttctacatgcacatgagcccacccactactttgaccatgtgcccttcatgtgaacacgtgtcggtcccgccaccacaacctcaggctgctacgtcagcacaccaccggacgttgccggtcaatgcgtgggctcctgcgacgaggatatctcacggcttgacttttgacgctcttcgtcctaggtcctaagtctttttacttacaatcaaagggcattgtggtcgttttattaagtttcagggaccagatatgcatgtagttgttaacatgtatgtattttttttagaaagaaagaaaaacagattaatatttttctagcttaaatc

SEQ ID NO: 710 - protein, 284 aa, Arabidopsis thaliana
  misc_feature (1)..(284): Ceres CLONE ID no. 42533
  misc_feature (1)..(284): Also Known As Ceres GEMINI ID no. 535A7
  misc_feature (1)..(109): Pfam Name: HD-ZIP_N Pfam Description: HD-ZIP protein N terminus
  misc_feature (129)..(183): Pfam Name: Homeobox Pfam Description: Homeobox domain
  misc_feature (184)..(228): Pfam Name: HALZ Pfam Description: Homeobox associated leucine zipper
MMLEKDDLGLSLGLNFPKKQINLKSNPSVSVTPSSSSFGLFRRSSWNESFTSSVPNSDSSQKETRTFIRGIDVNRPPSTAEYGDEDAGVSSPNSTISSSTGKRSEREEDTDPQGSRGISDDEDGDNSRKKLRLSKDQSAILEETFKDHSTLNPKQKQALAKQLGLRARQVEVWFQNRRARTKLKQTEVDCEFLRRCCENLTEENRRLQKEVTELRALKLSPQFYMHMSPPTTLTMCPSCEHVSVPPPQPQAATSAHHRTLPVNAWAPATRISHGLTFDALRPRS

SEQ ID NO: 711 - DNA, 592 bp, Arabidopsis thaliana
  misc_feature (1)..(592): Ceres CLONE ID no. 92991
  misc_feature (1)..(592): Also Known As Ceres GEMINI ID no. 531A2
gaaaaatcacttacttaacatactaagagagttattagaacttgcaaaaaatggcttccaaggctttgattctgttaggtctcttctcagttcttctcgtcgtctccgaagtgtctgccgcaaggcaatcgggcatggtgaagccagagagtgaggaaactgtgcaacctgaaggttatggcggtggccacggaggacatggtggtcacggagggggaggaggccacggacatggaggacacaacggaggagggggccacggacttgacggatacggaggaggtggaggacactatggaggaggtggaggacactacggaggaggtggaggacactacggaggaggtggaggacactacggaggaggtggtggaggacacggaggtggaggacactacggaggtggtggaggaggatacggaggtggaggaggacaccacggaggaggaggccacgggctaaacgaacctgttcagactaagccggggtgtttaaaactatataatatctttcaactaccatgcatgattgcatatatatatatacgcttatgtattatctatatgcctataaataaaccatggtgagtttg

SEQ ID NO: 712 - protein, 178 aa, Arabidopsis thaliana
  misc_feature (1)..(178): Ceres CLONE ID no. 92991
  misc_feature (1)..(178): Also Known As Ceres GEMINI ID no. 531A2
  misc_feature (1)..(99): Pfam Name: GRP Pfam Description: Glycine rich protein family
MASKALILLGLFSVLLVVSEVSAARQSGMVKPESEETVQPEGYGGGHGGHGGHGGGGGHGHGGHNGGGGHGLDGYGGGGGHYGGGGGHYGGGGGHYGGGGGHYGGGGGGHGGGGHYGGGGGGYGGGGGHHGGGGHGLNEPVQTKPGCLKLYNIFQLPCMIAYIYIRLCIIYMPINKPW

SEQ ID NO: 713 - protein, 157 aa, Arabidopsis thaliana
  misc_feature (1)..(157): Ceres CLONE ID no. 106944
  misc_feature (1)..(157): Functional Homolog of  Ceres CLONE ID no. 92991 at SEQ ID NO. 712 with e-value of 8.00E-85 and percent identity of 96.7
MASKALILLGLFSVLLVVSEVSAARQSGMVKPESEETVQPEGYGGGHGGHGGHGGGGGHGHGGHNGGGGHGLDGYGGGGGHYGGGGGHYGGGGGHYGGGGGHYGGGGGGHGGGGHYGGGGGGYGGGGGHHGGGGHGLNEPVQTKPGVYNLRCLMQYK

SEQ ID NO: 714 - protein, 204 aa, Medicago sativa
  misc_feature (1)..(204): Public GI no. 289123
  misc_feature (1)..(204): Functional Homolog of  Ceres CLONE ID no. 92991 at SEQ ID NO. 712 with e-value of 1.20E-28 and percent identity of 65.1
MDSKKAILMLSLLAMALISSVMSARDLTETSTDAKKEVVEKTNEVNDAKYGGGYNHGGGYNGGGYNHGGGYNHGGGGYHNGGGGYNHGGGGYNGGGGHGGHGGGGYNGGGGHGGHGGGGYNGGGGHGGHGGAESVAVQTEEKTNEVNDAKYGGGSNYNDGRGGYNHGGGGYNHGGGGHGGHGGHGGHGGHGGHGAVQTEDNTQN

SEQ ID NO: 715 - protein, 153 aa, Oryza sativa subsp. japonica
  misc_feature (1)..(153): Public GI no. 54291465
  misc_feature (1)..(153): Functional Homolog of  Ceres CLONE ID no. 92991 at SEQ ID NO. 712 with e-value of 6.89E-31 and percent identity of 63.4
MASKSLLLLSVVVASLLLVAQEVAAARELTEANEAKGKNMEPEVVHVPQDEKIAYHGDGYGHGGGYGGGYGSGYGGGNGGGYGGGYGGYGGGYGGGYGGGGGGGGYGGYGGYGGGGYEGYGRGYGGGGGGGGYGGGGYPGGGYYGGGGGGGWH

SEQ ID NO: 716 - protein, 156 aa, Fagus sylvatica
  misc_feature (1)..(156): Public GI no. 1405559
  misc_feature (1)..(156): Functional Homolog of  Ceres CLONE ID no. 92991 at SEQ ID NO. 712 with e-value of 8.19E-28 and percent identity of 61.7
MNSRAFIFLALLFASVLLISSAVATKTSKDEEKPEESNPVDDTKYGGYGGHYGGGHGGGYGGGHGGGYGGGHGGRGGGGGGRGGGGGYGGRREHVAEESIGRDTKYGGYGGGHGGHGGHGGGHGGGHGGGGGGPSRKLKAKLYNSLKSFASSYVPK

SEQ ID NO: 717 - protein, 144 aa, Daucus carota
  misc_feature (1)..(144): Public GI no. 585219
  misc_feature (1)..(144): Functional Homolog of  Ceres CLONE ID no. 92991 at SEQ ID NO. 712 with e-value of 2.90E-25 and percent identity of 61.2
MGSKIFLLLGLSIAFAILISSEVAARELAETAAKTEGYNNGGGYHNGGGGYNNGGGYHNGGGGYNNGGGYHNGGGGYNNGGGYHNGGGGYNNGGGHHNGGGGYNNGGGHHGGGGSCYHYCHGRCCSAAEAKALEATTAQVKPQN

SEQ ID NO: 718 - protein, 132 aa, Lycopersicon esculentum
  misc_feature (1)..(132): Public GI no. 19236
  misc_feature (1)..(132): Functional Homolog of  Ceres CLONE ID no. 92991 at SEQ ID NO. 712 with e-value of 2.90E-25 and percent identity of 60.3
MISSDVLARELAETSTTTSEEDSKKSSNKNEVHEAEYGGYPGGGGGYPGGGGYPGGGRGGGGGGYPGGGRSGGGGGYPGGGYPGGGGYRGGGGRYPGGGGGGRGGGRYSGGGGRGGGGGRGGRGGGGRKCCS

SEQ ID NO: 719 - protein, 144 aa, Chenopodium rubrum
  misc_feature (1)..(144): Public GI no. 18148
  misc_feature (1)..(144): Functional Homolog of  Ceres CLONE ID no. 92991 at SEQ ID NO. 712 with e-value of 1.20E-24 and percent identity of 60.3
MGSKIFLLLGLSIAFAILISSEVAARELAETAAKTEGYNNGGGYHNGGGGYNNGGGYHNGGGGYNNGGGYHNGGGGYNNGGGYHNGGGGYNNGGGHHNGGGGYNNGGGYHGGGGSCYHYCHGRCCSAAEAKALEATTAQVKPQN

SEQ ID NO: 720 - protein, 129 aa, Pisum sativum
  misc_feature (1)..(129): Public GI no. 2605889
  misc_feature (1)..(129): Functional Homolog of  Ceres CLONE ID no. 92991 at SEQ ID NO. 712 with e-value of 2.09E-29 and percent identity of 59.8
MDSRKAMLILGLLAMVLLISSEVSARELTEEVVEKSDEVNDAKYGGYGRGGGYHNGGGYHNGGGGYNGGGGYHNGGGGYNGGGGYHNGGGGYHNGGGGYNGGGGYHNGGGGYHGGGGHGGHGGASNNGN

SEQ ID NO: 721 - protein, 159 aa, Medicago sativa subsp. falcata
  misc_feature (1)..(159): Public GI no. 19547
  misc_feature (1)..(159): Functional Homolog of  Ceres CLONE ID no. 92991 at SEQ ID NO. 712 with e-value of 9.10E-29 and percent identity of 59.1
MVLLISSEVSARDLTETTSDAKKEVVEKTNEVNDAKYGGGYNHGGGGYNGGGYNHGGGGYNNGGGYNHGGGGYNNGGGGYNHGGGGYNNGGGGYNHGGGGYNNGGGGYNHGGGGYNGGGYNHGGGGYNHGGGGCQYHCHGRCCSHAEFVAMQAKDNTQN

SEQ ID NO: 722 - protein, 130 aa, Triticum aestivum
  misc_feature (1)..(130): Ceres CLONE ID no. 886552
  misc_feature (1)..(130): Functional Homolog of  Ceres CLONE ID no. 92991 at SEQ ID NO. 712 with e-value of 5.99E-25 and percent identity of 57.5
MASKGLLVFALLLAAAILVASTEQTQAKKEEKKAGVEGYGGGGGGGGYPGGGGGGYPGGGGGGYPGHGGGGGGGGYPGHGGGGGGGYPGHGGGGGGGYPGHGGGGGGSGCPWGCCGNGYHGCRCCARADE

SEQ ID NO: 723 - DNA, 592 bp, Arabidopsis thaliana
  misc_feature (1)..(592): Ceres CLONE ID no. 97474
  misc_feature (1)..(592): Also Known As Ceres GEMINI ID no. 534G7
attgttgtgaatttctgtgagattgagaatgcaggcggaggagataatatgccgtgtttcagacgaagagatcatcgagaattacctgaggccaaagataaacggtgaaacatcttcaatcccgagatatgttgtggaattggcagaggagctgtacactgtagagccttggctgcttcctcgacaaacagctccaattctcaaccctggcgagtggttctactttgggaaacgcaatcgaaagtatagtaacttggaaggtgttcattgcaagggatcgtggatactcgaagacggttgcatcgcagtcctgtccaaggagacgggtgaggaaattggtggaacgacgagatttaggtattactataggaacaagggggataaagagagtcgtctgaagatgagcaattggtttatgagagagtaacgtctctattacaaatccaggagagtcttcaatggacgtcaggttttctgcattatcacttgtaatgatgaacattttatcgaataattctctctgcttttttctaagataccattgtttaagatcctaattatgagtttgaatctataattataactctttgcc

SEQ ID NO: 724 - protein, 132 aa, Arabidopsis thaliana
  misc_feature (1)..(132): Ceres CLONE ID no. 97474
  misc_feature (1)..(132): Also Known As Ceres GEMINI ID no. 534G7
  misc_feature (11)..(132): Pfam Name: NAM Pfam Description: No apical meristem (NAM) protein
MQAEEIICRVSDEEIIENYLRPKINGETSSIPRYVVELAEELYTVEPWLLPRQTAPILNPGEWFYFGKRNRKYSNLEGVHCKGSWILEDGCIAVLSKETGEEIGGTTRFRYYYRNKGDKESRLKMSNWFMRE

SEQ ID NO: 725 - DNA, 1366 bp, Arabidopsis thaliana
  misc_feature (1)..(1366): Ceres CLONE ID no. 101603
  misc_feature (1)..(1366): Also Known As Ceres GEMINI ID no. 536H5
atattgaaaagaaccattgctctctagattaaaagcttctctctctctctctctctctcttttggactttctcaatccatatccctctctctgttttttctaatttgagcctctaaagtctcctcgttttgttcatgttgttgttcaagtgaagaagctcaattatgtttacaacattgttgtaatttcaaaacttcataagaatttctctgaaaataaagaaaaagctggagtagaactattttaaagtgtcatcatgaagagactaagcagctcagattcaatgtgtggtctaatctccacttctacagatgaacagagtccaagagggtacggaagtaattaccaatctatgcttgaaggttacgatgaagatgctacactaatcgaggaatattccggcaaccaccaccacatgggtctatcggagaagaagagaagattaaaagttgaccaagtcaaagctcttgagaagaatttcgaacttgagaataaactcgaacctgagaggaaaactaaattagcacaagagcttggacttcaacctcgtcaagtagctgtttggtttcagaaccgtcgtgcacggtggaaaacaaaacagcttgaaaaagattacggtgttcttaagggtcaatacgattctctccgccacaatttcgattctctccgccgtgacaatgattcccttctccaagagattagtaaaatcaaagctaaggtaaacggtgaagaagataacaacaacaacaaagctattacggagggtgttaaggaagaggaagttcacaagacggattcgattccttcgtctcctctgcagtttctagaacattcctctggttttaactaccggcgaagcttcactgacctccgtgaccttctaccgaattccaccgttgtcgaggctggatcttccgatagttgcgattcaagcgccgttcttaacgacgaaacaagttctgataacggaagattgacgccgcctgtgacggttactggcgggagtttcttacagtttgtgaaaacagagcaaacagaggatcacgaggattttctaagcggtgaagaagcttgtggtttcttctccgatgaacagccgccgtcacttcattggtactctgcttcagatcattggacttgagaattgtttatcaaattggtgctctgtttagtctcagtgggaaaacagagaagagggcaaaggtggaataattgataaataaggattaaggatgaaggggattattaaattaaatccgcgggagaagttaattttgggtttaagattgtaatggctcttcatgtaattaacgatgtcgagaggggctttcacagaaataggaatcaatggggacactctgatatg

SEQ ID NO: 726 - protein, 294 aa, Arabidopsis thaliana
  misc_feature (1)..(294): Ceres CLONE ID no. 101603
  misc_feature (1)..(294): Also Known As Ceres GEMINI ID no. 536H5
  misc_feature (114)..(158): Pfam Name: HALZ Pfam Description: Homeobox associated leucine zipper
  misc_feature (59)..(113): Pfam Name: Homeobox Pfam Description: Homeobox domain
MKRLSSSDSMCGLISTSTDEQSPRGYGSNYQSMLEGYDEDATLIEEYSGNHHHMGLSEKKRRLKVDQVKALEKNFELENKLEPERKTKLAQELGLQPRQVAVWFQNRRARWKTKQLEKDYGVLKGQYDSLRHNFDSLRRDNDSLLQEISKIKAKVNGEEDNNNNKAITEGVKEEEVHKTDSIPSSPLQFLEHSSGFNYRRSFTDLRDLLPNSTVVEAGSSDSCDSSAVLNDETSSDNGRLTPPVTVTGGSFLQFVKTEQTEDHEDFLSGEEACGFFSDEQPPSLHWYSASDHWT

SEQ ID NO: 727 - DNA, 1719 bp, Arabidopsis thaliana
  misc_feature (1)..(1719): Ceres CLONE ID no. 111757
  misc_feature (1)..(1719): Also Known As Ceres GEMINI ID no. 553F5
cccagaggatctagggcttcacaatcgattccttctctctatctcgacggatttagcttgcagatgtttcgtctcctctctggattcattaattcatcatcttctcttcttaaattctctatcttttcctgacaaagttagggtttttcgataactcgggatgagaataattggttcaatctaaagagctggctttgataaattattgagatttaaaagggtaattggaccttcctgaatcaattttcctggaaaaagaattgatttttagattgaaaaagaagtgagagtttctgtaactatgagggcattgcacaaaagggtatcgtggccaccagattttaaactttgtcaggtacggctattcatatcagaggattcaccttcacaagttggatcagagtctcaagatcacctgcaagcaaagtcaccattggcttcacatccaagtgatgataatctgccacctggttttggtggacccttttctgcgaatgagtcccagattaagttatcagatatcccactaataaagtggaaatgctccgtccagattctgctagatcgggaatggaaagtggttgcaggggacgaaagcaaagaagtggaggcccaaaatgagagggaattgagagttcttgaagcattttatcctggcgcatcatctattcctccaaacccttcggttccagctgatgttgaggactcacatcatgatgatcagcaaaccattgtcatacccatcctacctgtagaagatgatgacatagcgatggattcagcatctgatttcccaacccaatctggcgtggatgtgggaacagagccatcaataaccgatgagaacacatcaacttcttcaaccctccctgcagggccagatataatggctgcttatctgcaatctcaaacagcaaagaacaaggcagtatgatcgaccaagatctgcttattaaaatcctaagcaaccctaagttggtcgagaatcttgttgcaaatcgtggcagtgcaggttcagtctcctccaacacaagtagcctctactcatcttcaacacatgaagccaacggagtagtaaccacggcacctatttcctcaaatggacaattttacgctcagccacccataactcatattcctcccatggcgtatactcctcacgctcctcaagaccaaccgaactatggagcaccgccagcaagagatgctagttattacaagaacctgattcagcaacatggcggggatagacaagagacgccgccagttcaacatctcggttatcgatacaacctccaacctggaggaggacctaacccggagatggtaaatagcagtaataataaccagaggccaagggattcaaaacccaagataatgaaggcttgcatgtacttcaacagcgcaaggggttgtcgccatggagctaattgtatgtaccagcacgatgctacaccctaccagccgaggaatctaaacaatggtaatatcaacacttctgatatgcagaatgcaaaaagaatgagatttgacagagactgatgcagaattagcataccacacatgctctctgcctcttgctgttagcagcagagcaatttttctattttctcttgcctggctttactgcaatataagttttatatacatttgaaattatttcttggttttatgccacaaatgtagaattaattagcgagtattatttggctcaccacc

SEQ ID NO: 728 - protein, 210 aa, Arabidopsis thaliana
  misc_feature (1)..(210): Ceres CLONE ID no. 111757
  misc_feature (1)..(210): Also Known As Ceres GEMINI ID no. 553F5
MRALHKRVSWPPDFKLCQVRLFISEDSPSQVGSESQDHLQAKSPLASHPSDDNLPPGFGGPFSANESQIKLSDIPLIKWKCSVQILLDREWKVVAGDESKEVEAQNERELRVLEAFYPGASSIPPNPSVPADVEDSHHDDQQTIVIPILPVEDDDIAMDSASDFPTQSGVDVGTEPSITDENTSTSSTLPAGPDIMAAYLQSQTAKNKAV

SEQ ID NO: 729 - DNA, 1835 bp, Arabidopsis thaliana
  misc_feature (1)..(1835): Ceres CLONE ID no. 113719
  misc_feature (1)..(1835): Also Known As Ceres GEMINI ID no. 539C8
aaaaacttaaaccgatctatcaagcaagtggttcctctctctctctacctctcgtttttggccaacgtcgtcgtcttcacgatccacgacgattcagttcttgagttccggcgattatcggtctctcacttctggttccgttgaacccctcatttctcttctcgcccgttctctcaaattccgatatttgcccctgtgattcgaaaccctaatttcgcctatcaatctggaaaatctctcaattcgaagactttagcagcgcaaagatactctatccgggtaataagatcgaagaaaccatcaatttcttaccaaagtcgtgattcttggatctcgtctttgtttgatggacacaattagggtccaaggaggttcctggatcttcgaaatcgaccgcacagtcgctcacggagtcgacctctcgcacggaaaccatcaatggctcccacgaattcaagatcagcggctactctttggtcaaaggcatggggattggcaaatacgttacctcggatactttcatggtcggtggatactcctgggccatctacttctacccagatggaaagagtccagaggataattctgtctacgtgtctctcttcatagcccttgcgagtgaaggagccgatgttagggctttgtttgagcttaccctcgtggatcagagcggtaacgaaaggcacaaagttcatagccattttggtagaactctcgaaagcggaccctatactcttaaatatcgagggagtatgtggggatacaaacgatttttcaagaggtctcttttggagtcatcggactatctgaaggacaatggtctcttggtccgttgttgtgttggagtggtgaagtcacgcacagaaggaccgaggtgttacaatatcccggtgccggtttctggcttgggtcagcagtttggaaagcttttggaaagtgggaaaggagctgacgttactttcgaagttgatggagaaacatttcctgctcacaaattggttcttgcagcacgttctgcagttttcagggcacagctttttggcccgttgagaagtgaaaataccaattgtataatcatagaagacgtacaagcccctattttcaagatgttgcttcattttatctactgggatgaaatgcctgatatgcaagacttaatcggcacagacttgaaatgggcatcaactcttgtggctcagcatctgcttgcagctgcagaccgttatgctcttgagcggcttagaacaatatgcgagtcaaaactctgtgaaggaatcagcataaatacggtagcaaccaccttggctcttgcagagcagcatcattgtttccagctgaaagccacctgcctcaaatttatagctttgccagaaaacctgaaagctgtgatggaaacggatgggtttgattatctgaaggaaagctgcccgtccctactaagtgagctattggagtatgtggctaggctgagtgagcactctttaacatcatcagggcatcgaaaggagttatttgctgatggttgtgacttaaatgggagacgtgtgaagcaacggttacattagcaactaattgagagagagagagagagaggtcacttcgagagcctgagaagatgatggtgaagtaaacagaattttagaagagtaaagatttgtgtatttgtcattgtaaaaggattagtggttgatctgtgttgttcagctagctaatagagtgaaatgttgggtttttttcttttcttttctcttttgttttcccaggattttatgaccagaaccggttctctcaaggaaaaagtttcatgtgacttcattgataaatttggacttgcc

SEQ ID NO: 730 - protein, 359 aa, Arabidopsis thaliana
  misc_feature (1)..(359): Ceres CLONE ID no. 113719
  misc_feature (1)..(359): Also Known As Ceres GEMINI ID no. 539C8
  misc_feature (145)..(264): Pfam Name: BTB Pfam Description: BTB/POZ domain
  misc_feature (4)..(121): Pfam Name: MATH Pfam Description: MATH domain
MGIGKYVTSDTFMVGGYSWAIYFYPDGKSPEDNSVYVSLFIALASEGADVRALFELTLVDQSGNERHKVHSHFGRTLESGPYTLKYRGSMWGYKRFFKRSLLESSDYLKDNGLLVRCCVGVVKSRTEGPRCYNIPVPVSGLGQQFGKLLESGKGADVTFEVDGETFPAHKLVLAARSAVFRAQLFGPLRSENTNCIIIEDVQAPIFKMLLHFIYWDEMPDMQDLIGTDLKWASTLVAQHLLAAADRYALERLRTICESKLCEGISINTVATTLALAEQHHCFQLKATCLKFIALPENLKAVMETDGFDYLKESCPSLLSELLEYVARLSEHSLTSSGHRKELFADGCDLNGRRVKQRLH

SEQ ID NO: 731 - protein, 407 aa, Arabidopsis thaliana
  misc_feature (1)..(407): Public GI no. 79516480
  misc_feature (1)..(407): Functional Homolog of  Ceres CLONE ID no. 113719 at SEQ ID NO. 730 with e-value of 2.10E-164 and percent identity of 84.6
MGTTRVCSEVSSGSSKSLSQSLTVSTSTTETVNGFHEFKICGYSLAKGVGVGKYVASDTFMVGGYSWAIYFYPDGKSPEDNSSYVSLFIALASEGADVRALFELTLVDQSGNGKHKVHSHFGRALDSGPYTLKYRGSMWGYKRFFRRSSLESSDYLKENSLLVRCRVGVVKSVTEGPRYYNIPVPVSNLGQQLGNLLESGKGCDVVFQVDGETFNAHKLVLATRSPVFNAQLFGPLGDRNTKCITIEDMEAPIFKVLLHFIYWDELPDMQELIGTDSTLASTLVAQHLLAAADRYALERLKAICESKLCEGVAINTVATTLALAEQHHCLQLKAVCLKFVALPENLKAVMQTDGFDYLKESCPSLLTELLQYVARLSEHSVIVSGHRKEIFADGCDASGRRVKPRLH

SEQ ID NO: 732 - protein, 410 aa, Glycine max
  misc_feature (1)..(410): Ceres CLONE ID no. 713993
  misc_feature (1)..(410): Functional Homolog of  Ceres CLONE ID no. 113719 at SEQ ID NO. 730 with e-value of 6.40E-147 and percent identity of 75.1
MGKILRENAKPSANSSSAYPSAAPATTSSTSVTETVRGSHQFKITGYSLSKGIGIGKYMASDVFSVGGYNWAIYFYPDGKSVEDNATYVSLFIALASEGTDVRALFELTLLDQSGKERHKVHSHFERTLESGPYTLKYRGSMWGYKRFFKRTALETSDYLKDDCLSVNCSVGVVRSHTEGPKIYTIAIPPSSIGQKFGQLLESGKGSDVNFEVNGDIFAAHKLVLAARSPVFRAQLFGPMKDQNTQRIKVEDMEAPVFKALLHFIYWDSLPDMQELTGLNSKWASTLMAQHLLAAADRYGLERLRLMCEASLCEDVAINTVATTLALAEQHHCFQLKAVCLKFIATSENLRAVMQTDGFEYLKESCPSVLTELLEYVARFTEHSDIMCKHRNEALLDGSDINGRRVKQRL

SEQ ID NO: 733 - DNA, 1230 bp, Populus balsamifera subsp. trichocarpa
  misc_feature (1)..(1230): Ceres GDNA ANNOT ID no. 1513206
  misc_feature (1)..(1230): Functional Homolog of  Ceres CLONE ID no. 113719 at SEQ ID NO. 730 with e-value of 8.20E-147 and percent identity of 74.2
atgggcacaatcaggttttctagcagagacctctcagcaggaccggcctcattaaatccttcatcatcaattccaacaacaacatcgacttctataacggaaaccgtaaatgggtcacatgaattcaaggtcgatggctattcgctatcaaaaggcatggggataggcaaatacgtagcatcggatactttttacatcggtggctatgcatgggctatatatttttacccagatggtaaaagttctgaagataatgcctcttatgtctcgttattcatcgctcttgctagcgaggggactgatgttagggctttgtttgaattgacgttgatggatcaaagcgggaaagaaaggcataaggttcatagccattttggaagagcccttgagagtgggccttatacgcttaagtatcgcggcagtatgtggggttataaacgattttacaaaaggactcaattagagacttcagactttcttaaagatgataccctattaattcgctgttgtgttggtgttgttaagtcccacactgagggaccaaagacctacaccattgccgtgcccccttccaatattggtcagcattttggaaagcttttagacagtggaaagcgaacagatgtaaattttgaagttgatggagaaatctgtgcttcacacaagatagttctggcagcacgctcgccagtgtttagagcacaactttttggtccaatgaaggatcaaaacactcaatgcatcaaagttgaagacatggaagctcctgtttttaaggcattaatccattttatatactgggatgccttaccagacatggaggagcttgttggtttgaactcaaaatgggcttccacactgatggctcagcatctgcttgcagcagcagatcgctatgcacttgagaggctcagattgctttgtgaggctagactttgtgaagatgttgccataaacactgttgcaacaacactagctctagcagagcagcatcaatgcatccaactaaagtctgtttgtctcaaattcattgctttgcctgaaaatttgaaagctgtgatgcagacagatggatttgaatacttgaaggaaagttgcccttctgtcatcacggaactactgcaatatgttgccaaaaatggtgagcattctgtcatcgcttgtacacatggaaatgacaacttagatagcgatatgaatggaagacgagtgaagcaaaggattcattga

SEQ ID NO: 734 - protein, 357 aa, Populus balsamifera subsp. trichocarpa
  misc_feature (1)..(357): Ceres GDNA ANNOT ID no. 1513206
  misc_feature (1)..(357): Functional Homolog of  Ceres CLONE ID no. 113719 at SEQ ID NO. 730 with e-value of 8.20E-147 and percent identity of 74.2
MGIGKYVASDTFYIGGYAWAIYFYPDGKSSEDNASYVSLFIALASEGTDVRALFELTLMDQSGKERHKVHSHFGRALESGPYTLKYRGSMWGYKRFYKRTQLETSDFLKDDTLLIRCCVGVVKSHTEGPKTYTIAVPPSNIGQHFGKLLDSGKRTDVNFEVDGEICASHKIVLAARSPVFRAQLFGPMKDQNTQCIKVEDMEAPVFKALIHFIYWDALPDMEELVGLNSKWASTLMAQHLLAAADRYALERLRLLCEARLCEDVAINTVATTLALAEQHQCIQLKSVCLKFIALPENLKAVMQTDGFEYLKESCPSVITELLQYVAKNGEHSVIACTHGNDNLDSDMNGRRVKQRIH

SEQ ID NO: 735 - protein, 434 aa, Oryza sativa subsp. japonica
  misc_feature (1)..(434): Public GI no. 50939715
  misc_feature (1)..(434): Functional Homolog of  Ceres CLONE ID no. 113719 at SEQ ID NO. 730 with e-value of 1.70E-139 and percent identity of 70.8
MGAGRACRGGPSSSSPAAAAAAVGRPFPPIAASCPFSSSSAAAAAPAAPSETASTSVTKTVNGSHHFKIAGYPLAKGIGVGKYIASECFTVGGYDWAIYFYPDGKSPEDGAAYVSLFIALASEGTDVRALFELTLVDQSGKGQDKVHTHFGRSLEGGPYTLKYRGSMWGYKRFFKRSALETSDYLKDDCLLVNCTVGVVQSHTEGPKIYTIPVPPSNMSQHIGQLLTDGKRTDITFEVDGEVFPAHKVVLAARSPVFRAQLFGPMKDKNMKRITIEDMEASVFKALLHFMYWDELPDIEELTGLNTTWVSTLMAQHLLAAADRYALERLKLLCELKLCEDVAINTVANTLALAEQHHCYQLKTVCLRFVALPENLKAVMQTDGFDYLQQSCPSLLTELLEYVAKVGEHSVSPCLYSNEVLDGGDANGRRVKPRI

SEQ ID NO: 736 - protein, 425 aa, Zea mays
  misc_feature (1)..(425): Ceres CLONE ID no. 288779
  misc_feature (1)..(425): Functional Homolog of  Ceres CLONE ID no. 113719 at SEQ ID NO. 730 with e-value of 5.10E-138 and percent identity of 69.7
MGAGRVCRGGPFSASPAAGAAAGRPFPPLTASSSSPSSAPSETASTSVTKTVNGSHHFKIAGYSLSKGIGVGKFIASESFNVGGFDWAIYFYPDGKSGEDGAAYVSLFIALASEGTDVRALFELTLVDQSGKGQDKVHTHFGRSLESGPYTLKYRGSMWGYKRFFKRVALETSDYLKDDCLLVNCTVGVVQSHTEGPKIYTIPVPRSNMALHIGQLLTSGKRTDIAFEVDGEMFPAHKVILSARSPVFRAQLFGPMKDKDMKCIKIEDMEAPVFKALLHFMYWDELPDLEELTGVNTTWVSTLMAQHLLAAADRYALERLKLLCELKLCEDVAINTVANTLALAEQHHCYQLKTVCLKFVALPENLKAVMQTDGFDYLQQSCPSLLTELLEYVAKIGEHSVSPCLYSTEVLDGGDANGRRVKPRI

SEQ ID NO: 737 - DNA, 1771 bp, Arabidopsis thaliana
  misc_feature (1)..(1771): Ceres CLONE ID no. 117953
  misc_feature (1)..(1771): Also Known As Ceres GEMINI ID no. 533A6
ccgtaatctcaatcacaaactatttccccccttcgttcatcaaatcctcaagagaaaaaaaaaatccccaaaagcttcctcaaaaccctaacacagatctctcgatcttctccgatctgtcttttctcctaatctggtttagtttgatttaattggattgaagatgtcagacgctttgaatatgactcttgatgaaattgtgaagaagagtaagagtgaaaggtctgcagctgcaaggtctggaggtaaaggagtttcccgtaagagtggacgtggacgtggtggacctaatggtgttgtaggagctggaagaggaggtggacctgttcgtagaggtcctcttgctgttaatactcggccatcatcatccttctccataaacaaggcaagctcgaaatcttgattggaactctgtgccaccaaataccgaagcatgctaaaacttaagatggatgatcttttaatgctcttatgtccttggagaagaatcatacatgcataaaccgttacctctgatgatgattcagattacaagaatcttctaacatcttcttagaaaagcttctttcctgcaattagtggtttttatggttaaatactgggaacttcgagaggcatgcgtagatgtgcagaagttttcggttgatattgtcactcgctataggtttattgaagagctcctttaatctaagtagtccacatagggttatctacagggggataaagcctgaaaatgtgtgtggttctagggggaatttcagaaattttacttaaagagtaaataggatttatgatgggttatcaaagtgggggtatttgcactatgcatgaagttcacgatggtacatctggaatttcttcggagtgtgatggcagtctcagttttcgtttttggcttcagagactgactgataacaccacttgcccgcaggaagaggagcttgccatggcagaatcagaatgatttgtatgaagaaacccttagagctgttggggtgtcaggagtggaagtcggaaccacagtttatattaccaaccttgatcagggagtgacaaatgaagatataagggaactctatgctgagattggagagctgaaaagatatgcaattcactatgacaaaaatgggcgtccaagtggatcggctgaagttgtgtatatgagaagaagtgatgcaattcaagctatgaggaaatacaacaatgtacttttggatggaaggcctatgaaactggagattctgggtggaagtactgaatctgctcctgtcgcagctcgtgttaatgtgactggattgaatggaaggatgaagaggagtgtcttcattggacaaggagttagaggtgggagagtaggaagaggaagaggttcaggtccttctggaagacgccttccagtccaacaaaaccaacaaggtggtcgaggtggtcgaggcggggtccgtggtagaggcagaggtgctggtggaggcagagggaataaaagtggtggccgaggtggaaagaagccggtggagaagtctgctgcggatctcgacaaagatctcgaaagctatcatgctgaagctatgaacatctcttaaagcaagacttcgcatcttgtcatgtacttttgtgttctttattcgtagtctctgactaaatatgtgccaaagtctggtttggtttaattacgtttaggatggctctactctgctttcgttttcctcttttcttgtttcacactttcacagtcacttttggttattgaagttaaaagagatttagctgc

SEQ ID NO: 738 - protein, 140 aa, Arabidopsis thaliana
  misc_feature (1)..(140): Ceres CLONE ID no. 117953
  misc_feature (1)..(140): Also Known As Ceres GEMINI ID no. 533A6
MRRSDAIQAMRKYNNVLLDGRPMKLEILGGSTESAPVAARVNVTGLNGRMKRSVFIGQGVRGGRVGRGRGSGPSGRRLPVQQNQQGGRGGRGGVRGRGRGAGGGRGNKSGGRGGKKPVEKSAADLDKDLESYHAEAMNIS

SEQ ID NO: 739 - DNA, 508 bp, Arabidopsis thaliana
  misc_feature (1)..(508): Ceres CLONE ID no. 143475
  misc_feature (1)..(508): Also Known As Ceres GEMINI ID no. 533B6
aaaatcaagtcctttttcatcaagtcatacatacatcttccttcttctttttttctccctcccaagaagcagatcttgtactctcgatatacaaacttattcgtgatatggcttccaactcaatgagctctagcgcttcttggacacgtaaggagaacaaattatttgaaagggcgttggctacatatgaccaggacactcctgaccgttggcataacgttgcaagagccgttggcggcaaatcagctgaagaagtaaggcgacactacgagctcctcattagggatgtcaatgacattgagtcagggcgttatccacatcccaattaccgttcaaatggaaacaatcactgaaagcattgaaggaactccaaaaggctctactgaagtggacatggttccaaaaccattcacaaagcacatctaagcaaagatatctaaatgtatttacttgtttttgtgttacgaatatgtaagaattatctaaatcaatcaatgtggtttcatat

SEQ ID NO: 740 - protein, 81 aa, Arabidopsis thaliana
  misc_feature (1)..(81): Ceres CLONE ID no. 143475
  misc_feature (1)..(81): Also Known As Ceres GEMINI ID no. 533B6
  misc_feature (9)..(58): Pfam Name: Myb_DNA-binding Pfam Description: Myb-like DNA-binding domain
MASNSMSSSASWTRKENKLFERALATYDQDTPDRWHNVARAVGGKSAEEVRRHYELLIRDVNDIESGRYPHPNYRSNGNNH

SEQ ID NO: 741 - DNA, 1510 bp, Arabidopsis thaliana
  misc_feature (1)..(1510): Ceres CLONE ID no. 150246
  misc_feature (1)..(1510): Also Known As Ceres GEMINI ID no. 539H5
agactatccacatagccgtcgtcttcctcgccggacatgctagaagataacaatccacacccaaacttacccagagagacaatctctgattcacgtccactacaattaccgaatctctccgaagccaccgatcacctacgctagtttcagtggcaattcgaagcttccaatgagtttgttctgtaattcaatcgaaaccctttatccaaaaccattcctttcacacaaatctcacttctttaccttctccaattccaaattccaaaaccctaaattcacaagcttcccacttcgtcaccaatgccggatcgaatcatgtctgaaatcagcatcttcatcagaaatcgatatggtaagaaacaaagaaggtatctttgcaccaaaggagaagaaagttgtagtcttatgggacttagacaacaaaccaccacgaggtccaccatacgaagccgcaacagctctccgtaaagtcgctgagaaactcggccgagtcgtcgaaatctccgcttacgcaaatcgtcatgcttttatccatttacctcattgggtcgtcgaagagagacgagaaaggaggaaccttgatttcatggagaggaaaggagaagtgactccaattgatccgtacatttgtggtgtttgtggtcgcaagtgtaaaaccaatcttgatttgaagaaacatttcaagcagcttcatgagagggagagacagaagaaagttaataggatgagatctttgaaaggtaagaaacgtcagaagtttaaggagcgttatgtttcagggaatgagaagtataatgaggctgcgaggagtttgttgactcctaaagttggatatggtttagaggctgagctacgtcgagcaggggtttatgttaagacggttgaggataagcctcaggctgcggattgggcggttaagagacagatacaacattcaatgactagagggattgattggttggttttggtgtcggatgataaggatttttctgatatgttgaggaaagctagagaggctgatcttgggactttggttgttagtgatatggatagagcattgggaaggcatgctgatttgtgggtgccttggagtggtgttgagaagggagagattggtgagaaggatttgattccggggaagagaccaaggtttgaggaggatgaggtgggatttggtggtaatgatgagttgttttccgttgtccgtatgatgaggatgagaaggcggagatgacggtggagagtgatgggtttgggaggtttaatgtatcggcgttttcggaagatgaatgggtggaggatgaaggagactttgtgttgagtgatagtagtgatgatgatagtgatgatgagcttttctgattcatggtgaattgagttgcatttctaagtgttgttaattggtttacgaatagagttcataggagctttggtcgatgtaattgaaatcaaatgtaaaaccattcttacataagccaagattttgtgcattcatgcggtaaaagccatg

SEQ ID NO: 742 - protein, 354 aa, Arabidopsis thaliana
  misc_feature (1)..(354): Ceres CLONE ID no. 150246
  misc_feature (1)..(354): Also Known As Ceres GEMINI ID no. 539H5
MSLFCNSIETLYPKPFLSHKSHFFTFSNSKFQNPKFTSFPLRHQCRIESCLKSASSSEIDMVRNKEGIFAPKEKKVVVLWDLDNKPPRGPPYEAATALRKVAEKLGRVVEISAYANRHAFIHLPHWVVEERRERRNLDFMERKGEVTPIDPYICGVCGRKCKTNLDLKKHFKQLHERERQKKVNRMRSLKGKKRQKFKERYVSGNEKYNEAARSLLTPKVGYGLEAELRRAGVYVKTVEDKPQAADWAVKRQIQHSMTRGIDWLVLVSDDKDFSDMLRKAREADLGTLVVSDMDRALGRHADLWVPWSGVEKGEIGEKDLIPGKRPRFEEDEVGFGGNDELFSVVRMMRMRRRR

SEQ ID NO: 743 - DNA, 1260 bp, Populus balsamifera subsp. trichocarpa
  misc_feature (1)..(1260): Ceres GDNA ANNOT ID no. 1486526
  misc_feature (1)..(1260): Functional Homolog of  Ceres CLONE ID no. 150246 at SEQ ID NO. 742 with e-value of 2.80E-121 and percent identity of 70.5
atgactcctctctgcaaagccatagacaccaccacagcttctctactaaaaccctcaattctcctccacaaaacaccccttaacttttgccactctctcaattacacccctaatctcagcaacaacaacctcactctcacttcaaaaccgccacaaaaccacctccgcccaatcaccgccacagccaacgccagccacccagctgcgacatccgaaatcgacatggtaaaaaacagacaaggaatctacacgtcaaaacagaacaaagttgttgttttatgggacctcgacaacaaacccccacgtgggccgccgtacccggcggctatggcattaaaaacagtagcacaaagattcggtgaggtaatcgacatgtgtgcatacgctaaccggcacgcgtttattcatttgccacactgggtgcttgaagaaaggcgtgagagaaaacacttggacattttggagagaaaagaaattgtaagcccttcacagccttatgtctgtggcgtttgtgggcgcaaatgtaagactaatttggatttgaagaagcattttaagcaattacatgagagggaaagacagaagaaggtgaacagaatgagatcgttgaaagggaaaaaacggcagcgatataaggagaggtttgtatctgggaatcataagtacaatgaggaagcaaggaggttgttaactccgaaaattgggtatgggttagccgcagagttgaagagagctggggtttacgtgaagacagtggaggataagccacaagctgcagattgggcattgaagagacaaattgagcattcaatgagtagaggggtggattggttggttttggtttcagatgattcggatttttcggagattttaaggaaggcgagggaggccaatttgggcactgtcgtggtgggggatagggatagagcattggggaggcatgctgatttgtgggttccatggattggggttgagaatggggagctgactgagaaggatttggtgccgaaaggtaggtggaggagtgaggatttggaaaatgatgaggggttgttttcggttacggattttgatgaggatggtgattacggggggaatgatttggagggatttgttgatggacttgtaatggcgaggtctgggtttaatggtacgaggatttcagctttttcagaaggggaagaggaagatgagcaggattatttgttatatgatagtgagtatgaggaaattgaacttgaagatgggggtttttggtaa

SEQ ID NO: 744 - protein, 419 aa, Populus balsamifera subsp. trichocarpa
  misc_feature (1)..(419): Ceres GDNA ANNOT ID no. 1486526
  misc_feature (1)..(419): Functional Homolog of  Ceres CLONE ID no. 150246 at SEQ ID NO. 742 with e-value of 2.80E-121 and percent identity of 70.5
MTPLCKAIDTTTASLLKPSILLHKTPLNFCHSLNYTPNLSNNNLTLTSKPPQNHLRPITATANASHPAATSEIDMVKNRQGIYTSKQNKVVVLWDLDNKPPRGPPYPAAMALKTVAQRFGEVIDMCAYANRHAFIHLPHWVLEERRERKHLDILERKEIVSPSQPYVCGVCGRKCKTNLDLKKHFKQLHERERQKKVNRMRSLKGKKRQRYKERFVSGNHKYNEEARRLLTPKIGYGLAAELKRAGVYVKTVEDKPQAADWALKRQIEHSMSRGVDWLVLVSDDSDFSEILRKAREANLGTVVVGDRDRALGRHADLWVPWIGVENGELTEKDLVPKGRWRSEDLENDEGLFSVTDFDEDGDYGGNDLEGFVDGLVMARSGFNGTRISAFSEGEEEDEQDYLLYDSEYEEIELEDGGFW

SEQ ID NO: 745 - protein, 360 aa, Medicago truncatula
  misc_feature (1)..(360): Public GI no. 92881423
  misc_feature (1)..(360): Functional Homolog of  Ceres CLONE ID no. 150246 at SEQ ID NO. 742 with e-value of 3.69E-112 and percent identity of 68.3
MNTLSLHFYTPHSFLSLKPKPQPRIQCCSTNNNIIDDIDMVKTKQGTYEQKQNKVCVLWDLDNKPPRGPPYNAAVSLKNLAERFGDVTDISAYANRHAFIHLPQWVLNQRRERKNLDILERKGIINPPEPYVCSVCGRKCKTNVDLKKHFKQLHQRERQKKLNRLNSLKGKKRQKYKERFVSGDDKYNDAVREILKPKVGYGLASELRRAGVFVKTVEDKPQAADWALKKQMMHSMSRGIDWLFLVSDDSDFSEMLRKAREANLGTVVVGDVDRALGRHADLWVPWNAVENGEVMDMDLIPRNRDRRRTNSTSTTMDDFGDVLFFHEGEEMEDDFMLEYSDDDDFDEDSDEEDEDGFYIY

SEQ ID NO: 746 - protein, 410 aa, Oryza sativa subsp. japonica
  misc_feature (1)..(410): Public GI no. 55741380
  misc_feature (1)..(410): Functional Homolog of  Ceres CLONE ID no. 150246 at SEQ ID NO. 742 with e-value of 2.69E-93 and percent identity of 61.9
MPPPLSFLHLAANPTPLHASPLRRARLRHRLSLRTDHPSRRAVASASASAGENPSTPGGPIADVEMVRGKDGVWTARPPTVVVLWDLDNKPPRGPPFPAATALRDAASLLGRVVSVSAFANRHAFSHVPAWVADERRERRAMDRAERAGAASPPVPYSCAVCGRRFPTRPDLTRHFRQLHQRERNKKLSRLRSLKGKKRQKFRERFISGNTKYDDAARELLTPKVGYGLAAELRRAGVHVRTVSDKPQAADHALKRQVKHSVACGVDWLVLVSDDSDFTDTVRKARAADLRTVVVGDGCRALGSVADIWLPWDRVENGEVDEDMLRNGTHMGFRDEEEDEQDDDEFIVDWDTSDLDGVVDDIVATRTKLFGATTMSAFADEEIMDGILGVGINGGDMLWSSDDEDEDGYF

SEQ ID NO: 747 - DNA, 1118 bp, Arabidopsis thaliana
  misc_feature (1)..(1118): Ceres CLONE ID no. 151587
  misc_feature (1)..(1118): Also Known As Ceres GEMINI ID no. 539B5
ataacaacaaactaacaaacaacaacaacaacaacaagaaaggcaagagttgatcagttagagcgatggacgtttttgttgatggtgaattggagtctctcttggggatgttcaactttgatcaatgttcatcatctaaagaggagagaccgcgagacgagttgcttggcctctctagcctttacaatggtcatcttcatcaacatcaacaccataacaatgtcttatcttctgatcatcatgctttcttgctccctgatatgttcccatttggtgcaatgccgggaggaaatcttccggccatgcttgattcttgggatcaaagtcatcacctccaagaaacgtcttctcttaagaggaaactacttgacgtggagaatctatgcaaaactaactctaactgtgacgtcacaagacaagagcttgcgaaatccaagaaaaaacagagggtaagctcggaaagcaatacagttgacgagagcaacactaattgggtagatggtcagagtttaagcaacagttcagatgatgagaaagcttcggtcacaagtgttaaaggcaaaactagagccaccaaagggacagccactgatcctcaaagcctttatgctcggaaacgaagagagaagattaacgaaaggctcaagacactacaaaaccttgtgccaaacgggacaaaagtcgatataagcacgatgcttgaagaagcggtccattacgtgaagttcttgcagcttcagattaagttgttgagctcggatgatctatggatgtacgcaccattggcttacaacggcctggacatggggttccatcacaaccttttgtctcggcttatgtgaaggacttacaagttacaatgtcaatgtaaagaaacccatttagaacatatatatccctatttgagccaaactaaagagatctaccctaagatcctaccattttcttgttgttgttcattctgatatttttattattctttaacttcttttgtctctttcgtcattatggttctaagaacttttggtactctttttcttttctttwttgtaattatatttttaaattatgaaaaagtcaactcagactaattaaataacaatcgtctttccttttgc

SEQ ID NO: 748 - protein, 258 aa, Arabidopsis thaliana
  misc_feature (1)..(258): Ceres CLONE ID no. 151587
  misc_feature (1)..(258): Also Known As Ceres GEMINI ID no. 539B5
  misc_feature (176)..(223): Pfam Name: HLH Pfam Description: Helix-loop-helix DNA-binding domain
MDVFVDGELESLLGMFNFDQCSSSKEERPRDELLGLSSLYNGHLHQHQHHNNVLSSDHHAFLLPDMFPFGAMPGGNLPAMLDSWDQSHHLQETSSLKRKLLDVENLCKTNSNCDVTRQELAKSKKKQRVSSESNTVDESNTNWVDGQSLSNSSDDEKASVTSVKGKTRATKGTATDPQSLYARKRREKINERLKTLQNLVPNGTKVDISTMLEEAVHYVKFLQLQIKLLSSDDLWMYAPLAYNGLDMGFHHNLLSRLM

SEQ ID NO: 749 - DNA, 1523 bp, Arabidopsis thaliana
  misc_feature (1)..(1523): Ceres CLONE ID no. 159557
  misc_feature (1)..(1523): Also Known As Ceres GEMINI ID no. 555D11
aaaaaaattttacacttatgctcttcatatcacatacaacaaacccatatatataaaaactttaaccttcgtatagcaacgatctagtagaaagcttatactaaaactttctgattctcttaatatggcggaggagtttaaagctacggcatcgatttgtggtggcggaggtagcgcgtggtggaactcgccaaggagcgttatgtctccttcggatcatttcttgtcaccatgcttcggagcggctatcacttccaatgattttagctcgcaagagaatcatctcaaatctaggatgacttgtacggacaacaacaacatcgttttcgggcagcgagaggcggattctgacagtggaggaagtaccgtgacgatggactcgacgttgcagatgatgggtctagggttttcctcaaattgttcttcagattggaaccaaaccattttacaagaagacttaaactcaagcttcataaggagctcacaagatcaagatcatggccaaggattcttatccacaactacttcaccttatatacttaatccagcttgttcttcatctccatcaacttcttcgtcctcaagcttgatacgaaccttttacgatcccgaaccaagtccatacaactttgtctccaccacaagtggttcaatcaacgatcctcaactttcttgggctaataagacaaatcctcatcatcaagtagcttatggactaattaacagcttctctaacaacgcaaactctcgacccttttggaattcttcatcaaccactaacttaaacaacacgacgccgagcaattttgtaaccactccgcagataatatctactcgtttggaggacaaaaccaagaatctgaagacaagagctcagagtgagtctttgaagagagcaaaggataatgaatctgcggcgaagaaaccgagagtcaccacgccttcaccgttgccaactttcaaggtgagaaaagagaatctaagggaccagataacttcattacaacaactagtttcacctttcggaaagacagatactgcatctgttctccaagaagctatagagtacatcaagttccttcacgaccaagtcactgttctaagcactccatacatgaaacaaggtgcctcgaaccaacaacaacagcagatatctggtaaatcgaagagtcaagatgaaaatgagaatcacgaactaagaggacatggtctatgtctcgtcccaatatcaagcacgtttccggtggctaacgaaacaacagccgatttttggacaccaacgtttgggggcaacaatttcaggtgattaaagagagagggttgtggttgtcaagacggatgggaacatatgctaaattcagcttggagactctaaagcataacaataatttttaatgtattttcttcttctttcaatattttaaggggggtttattgctgaatttagcatatatgggttgtttttatgttgaataaccttttgttcctgtcattgttcttgaatatatatacatatttttgtc

SEQ ID NO: 750 - protein, 393 aa, Arabidopsis thaliana
  misc_feature (1)..(393): Ceres CLONE ID no. 159557
  misc_feature (1)..(393): Also Known As Ceres GEMINI ID no. 555D11
  misc_feature (284)..(320): Pfam Name: HLH Pfam Description: Helix-loop-helix DNA-binding domain
MAEEFKATASICGGGGSAWWNSPRSVMSPSDHFLSPCFGAAITSNDFSSQENHLKSRMTCTDNNNIVFGQREADSDSGGSTVTMDSTLQMMGLGFSSNCSSDWNQTILQEDLNSSFIRSSQDQDHGQGFLSTTTSPYILNPACSSSPSTSSSSSLIRTFYDPEPSPYNFVSTTSGSINDPQLSWANKTNPHHQVAYGLINSFSNNANSRPFWNSSSTTNLNNTTPSNFVTTPQIISTRLEDKTKNLKTRAQSESLKRAKDNESAAKKPRVTTPSPLPTFKVRKENLRDQITSLQQLVSPFGKTDTASVLQEAIEYIKFLHDQVTVLSTPYMKQGASNQQQQQISGKSKSQDENENHELRGHGLCLVPISSTFPVANETTADFWTPTFGGNNFR

SEQ ID NO: 751 - DNA, 779 bp, Arabidopsis thaliana
  misc_feature (1)..(779): Ceres CLONE ID no. 206045
  misc_feature (1)..(779): Also Known As Ceres GEMINI ID no. 539G2
atttctgttcatttcacctttactaaaaagagaactcacatcaaagaaacagtccatcattcacatgatctagatgagcatcattactaattatcttgtaacgaatgatcactaatgtttttgactattctatgcagctctagtggcactcctaccacaggaacaccaactagtgggacaccaaccagtgggaccccgactaccggaactccgaccaccggaacccccaccactggaactccaaccagtgggactccaactagtggcttcccaaataccgggactccgaacacagggactaacactgggatgccaaattccaacgggatgccaacttcatcgtcatcttcggtgttcccggggactactcttggaccgactggtagcgggggactaggcgatccaaatgctggagagaagctgtctgttcgaactaacacattggtcttcttattaaccggtgtagcagcaatgcttgtcatatgagggcttagatgtcacacgcggttatggttgtaattgggtttgctgagagatcagatcttgcctacggctcatggttgatagagccatctttttttcactcgtctttctaggatttggacttaggttggccgagagacataatgctggtagtagctagtattttgggttatgtacaactttaactaagagctttacttttgtaaatccggaggatgagatgctcttttgtttcttatattctttttaatccttttactttgatctttcatcttttaatacgtaccatcattgtc

SEQ ID NO: 752 - protein, 123 aa, Arabidopsis thaliana
  misc_feature (1)..(123): Ceres CLONE ID no. 206045
  misc_feature (1)..(123): Also Known As Ceres GEMINI ID no. 539G2
MFLTILCSSSGTPTTGTPTSGTPTSGTPTTGTPTTGTPTTGTPTSGTPTSGFPNTGTPNTGTNTGMPNSNGMPTSSSSSVFPGTTLGPTGSGGLGDPNAGEKLSVRTNTLVFLLTGVAAMLVI

SEQ ID NO: 753 - protein, 222 aa, Arabidopsis thaliana
  misc_feature (1)..(222): Public GI no. 16323412
  misc_feature (1)..(222): Functional Homolog of  Ceres CLONE ID no. 206045 at SEQ ID NO. 752 with e-value of 6.60E-58 and percent identity of 98.2
MSVLLPLCLIISMFTYSNAAYCLCKEGNEQVLQKAIDYACGNGADCTQIQPTGACYQPNTVKNHCDVAVNSYYQKKASSGATCDFNGAASPSTTPPSTASNCLTGSSSSGTPTTGTPTTGTPTSGTPTTGTPTTGTPTTGTPTSGTPTSGFPNTGTPNTGTNTGMPNSNGMPTSSSSSVFPGTTLGPTGSGGLGDPNAGEKLSVRTNTVVFLLTGVAAMLVI

SEQ ID NO: 754 - protein, 232 aa, Zea mays
  misc_feature (1)..(232): Ceres CLONE ID no. 1370494
  misc_feature (1)..(232): Functional Homolog of  Ceres CLONE ID no. 206045 at SEQ ID NO. 752 with e-value of 1.60E-45 and percent identity of 83.6
MSVLLPLCLVLSMITYSNAAYCVCKDGNEQVLQKAIDYACGAGADCSQIQQNGACFQPNTVKNHCDVAVNSYYQKKASSGATCDFNGAAVISTSPPSTASSCLTGSSSSGTPSTGTPTTGTPSTGTPTTGTPSTGTPTTGTPTSGFPSTGTPSTGTPTAGMPTTGTPSTGMPNSGTPANGMPTSSSSSVFPGTTLGPTGSGGFGDPNAGEKISVRTNTAFFFLTGVAIMLVV

SEQ ID NO: 755 - DNA, 645 bp, Populus balsamifera subsp. trichocarpa
  misc_feature (1)..(645): Ceres GDNA ANNOT ID no. 1464350
  misc_feature (1)..(645): Functional Homolog of  Ceres CLONE ID no. 206045 at SEQ ID NO. 752 with e-value of 2.80E-11 and percent identity of 55.4
atggctgttttagtgtttttaggtcttttcttggccctcactggccattcaagtgctacttactgcatatgcaaggatggggttggtgacacacagctgcaaaagagcctggattatgcttgtggagccggagctgactgtacccaaatcattcaaaatgccccttgttaccagcccaacactgtaaaagatcactgcagctatgctgttaacagctacttccagaagaagggccaagctgttgggagctgtgatttttcaggaactgccatgactagcgccactccccctcaaagtgtagcctctgggtgtacatatcctgcatctgcaactccaagcacagggacaggcaacaccccaacaaccaccactccaagcacaggcacaacacccaccggcacaggcacaacacctacaggcacaggcaccggcaccagcacaggcacaggcacaggcacaggcacaggcacaggcacaccttcatctataattcctaccccgccttcatcagtgttcaactcaggattgggcccaactggtttcaatgataatagtagtgaggctcctgcttttaagggcactaacttgtggttcattgcatctttgaccctcttgttttcaggcatatttttgttctggggttga

SEQ ID NO: 756 - protein, 214 aa, Populus balsamifera subsp. trichocarpa
  misc_feature (1)..(214): Ceres GDNA ANNOT ID no. 1464350
  misc_feature (1)..(214): Functional Homolog of  Ceres CLONE ID no. 206045 at SEQ ID NO. 752 with e-value of 2.80E-11 and percent identity of 55.4
MAVLVFLGLFLALTGHSSATYCICKDGVGDTQLQKSLDYACGAGADCTQIIQNAPCYQPNTVKDHCSYAVNSYFQKKGQAVGSCDFSGTAMTSATPPQSVASGCTYPASATPSTGTGNTPTTTTPSTGTTPTGTGTTPTGTGTGTSTGTGTGTGTGTGTPSSIIPTPPSSVFNSGLGPTGFNDNSSEAPAFKGTNLWFIASLTLLFSGIFLFWG

SEQ ID NO: 757 - protein, 215 aa, Glycine max
  misc_feature (1)..(215): Ceres CLONE ID no. 584351
  misc_feature (1)..(215): Functional Homolog of  Ceres CLONE ID no. 206045 at SEQ ID NO. 752 with e-value of 2.40E-12 and percent identity of 53.0
  misc_feature (213)..(213): Xaa is any aa, unknown, or other
MALLMYFVLFLALAGHSSALYCVCKDGVGDQALQKAIDYACGAGADCTPILQNGACFQPNTVKDHCNYAVNSYFQRKGQAQGSCDFSGAATPSQTPPTAASTCVYPSSPSNAGTGTTATPTTTTPTTGTPPITLTPTTPTSTTPGIGTGTGTTTGTGTGTGTTTGNPNVFGMSPTSSTGTGGGFNDSNKGVVHLQDTSMLLVSLVLTLLLVLXRV

SEQ ID NO: 758 - DNA, 1307 bp, Arabidopsis thaliana; identical to SEQ ID NO: 205
  misc_feature (1)..(1307): Ceres CLONE ID no. 207419
  misc_feature (1)..(1307): Also Known As Ceres GEMINI ID no. 539D5
  misc_feature (1)..(1307): Also Known As Ceres CDNA ID no. 23371023
  misc_feature (1)..(1307): Also Known As Ceres GEMINI ID no. 539D5

SEQ ID NO: 759 - protein, 311 aa, Arabidopsis thaliana; identical to SEQ ID NO: 206
  misc_feature (1)..(311): Ceres CLONE ID no. 207419
  misc_feature (1)..(311): Also Known As Ceres CDNA ID no. 23371023
  misc_feature (1)..(311): Also Known As Ceres GEMINI ID no. 539D5
  misc_feature (1)..(311): Also Known As Ceres GEMINI ID no. 539D5
  misc_feature (272)..(298): Pfam Name: zf-CCCH Pfam Description:

SEQ ID NO: 760 - DNA, 808 bp, Zea mays
  misc_feature (1)..(808): Ceres CLONE ID no. 207834
  misc_feature (1)..(808): Also Known As Ceres GEMINI ID no. 538C5
caggatagtttggctaccctcgtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtggagagcccgcgcaaggactgcgaccaggtgcaggcggacagggaccgcgccggcgtcctgctcaccaggaacgtcggcatcagcgacaacctgcgccccgccaacccgctcggctacctcaaggacgtgccgctgcccatctgcgcctcgctgctcaaacagttggactcggacgacgacgacgatcagtaatagcacatcgacgacgacgatcgatatgtaatagcacgtcgtcgacgaccgaccgcagtcgtcgcagactggctggcactaaaccacaaatcctcttcacctggattacaaatatgtaactgagaaaggaaaggaaaacaaaaatgtaactgcgtggctgtaccaaattctgagtgctggattcttgc

SEQ ID NO: 761 - protein, 167 aa, Zea mays
  misc_feature (1)..(167): Ceres CLONE ID no. 207834
  misc_feature (1)..(167): Also Known As Ceres GEMINI ID no. 538C5
  misc_feature (34)..(154): Pfam Name: Pollen_Ole_e_I Pfam Description:
MASIPATTFAVILSVLFCAAAGTAVDNDLPDYVIQGRVYCDTCRAGFVTNVTEYIAGAKVRLECKHFGTGKLERSIDGVTDGNGTYTIELKDSHEEDICEVVLVESPRKDCDQVQADRDRAGVLLTRNVGISDNLRPANPLGYLKDVPLPICASLLKQLDSDDDDDQ

SEQ ID NO: 762 - protein, 170 aa, Zea mays
  misc_feature (1)..(170): Ceres CLONE ID no. 384289
  misc_feature (1)..(170): Functional Homolog of  Ceres CLONE ID no. 207834 at SEQ ID NO. 761 with e-value of 6.09E-71 and percent identity of 89.0
MASVPAPATTTAAVILCLCVVLSCAAADDPNLPDYVIQGRVYCDTCRAGFVTNVTEYIAGAKVRLECKHFGTGKLERAIDGVTDATGTYTIELKDSHEEDICQVVLVASPRKDCDEVQALRDRAGVLLTRNVGISDSLRPANPLGYFKDVPLPVCAALLKQLDSDDDDDQ

SEQ ID NO: 763 - protein, 165 aa, Oryza sativa subsp. japonica
  misc_feature (1)..(165): Public GI no. 50923969
  misc_feature (1)..(165): Functional Homolog of  Ceres CLONE ID no. 207834 at SEQ ID NO. 761 with e-value of 1.19E-60 and percent identity of 73.3
MASLRTIPVIFGILFYVLASTATATDAPDYVVQGRVYCDTCRAGFETNVTEYIKGAKVRLECKHFGTDKVERAIDGVTDETGTYKIELKDSHEEDICEVVLVHSPLANCSEIEAERDRARVLLTRNVGICDNLRLANPLGYLKDIPLPICGALLKQFDLADDDNE

SEQ ID NO: 764 - protein, 164 aa, Oryza sativa subsp. indica
  misc_feature (1)..(164): Public GI no. 20310
  misc_feature (1)..(164): Functional Homolog of  Ceres CLONE ID no. 207834 at SEQ ID NO. 761 with e-value of 6.79E-56 and percent identity of 71.3
MASLRTIPVIFGILFYVLASTATATDAPDYVVQGRVYCDTCRAEFETNVTEYIKGAKVRLECKHFGTDKVERAIDGVTDETGTYKIELKDSHEEDICEVVLVHSPLANCSEIEAERDRARVLLTRNVGICDNLRLANPLGYLKDYHCPSAALLKQFDLADDDNE

SEQ ID NO: 765 - protein, 160 aa, Lilium longiflorum
  misc_feature (1)..(160): Public GI no. 25990491
  misc_feature (1)..(160): Functional Homolog of  Ceres CLONE ID no. 207834 at SEQ ID NO. 761 with e-value of 1.20E-35 and percent identity of 54.6
MSKLYFLAFVAVASLSFRLSLADPNPTFIVEGRVYCDSCRAGFETNITTYIEGAKVKLECRHFDNDSIAHTVEGVTNSTGTYSIQLENDHESEICEVVLVSSPIFDCNEIDYDRDRARVTLTNNNGIDSPIRYANSLGFLQEQPDIICGDLLKAYGIADP

SEQ ID NO: 766 - protein, 157 aa, Glycine max
  misc_feature (1)..(157): Ceres CLONE ID no. 710471
  misc_feature (1)..(157): Functional Homolog of  Ceres CLONE ID no. 207834 at SEQ ID NO. 761 with e-value of 2.39E-28 and percent identity of 48.8
MATRVLLLMALTLYIFPIATATFHVKGSVYCDTCRAGFETNATFYIRGARVGIQCKERKTMKVAFYSEGVTDSTGTYHIEVENDHRDNICECLLVKSPIKWCSTPDSGRDKSSIVLTHSQNGIVNHLHYANAMGYLRDEPLPECHKLLKYYLADSDV

SEQ ID NO: 767 - DNA, 1290 bp, Arabidopsis thaliana
  misc_feature (1)..(1290): Ceres CLONE ID no. 248061
  misc_feature (1)..(1290): Also Known As Ceres GEMINI ID no. 555G8
  misc_feature (556)..(556): n is a, c, t, g, unknown, or other
  misc_feature (558)..(558): n is a, c, t, g, unknown, or other
  misc_feature (603)..(603): n is a, c, t, g, unknown, or other
  misc_feature (667)..(667): n is a, c, t, g, unknown, or other
  misc_feature (711)..(711): n is a, c, t, g, unknown, or other
  misc_feature (717)..(717): n is a, c, t, g, unknown, or other
  misc_feature (843)..(843): n is a, c, t, g, unknown, or other
aaaaaaataatgggacttaaaggatatagcgtcggagaaggaggaggagagatagttgaggttcaaggcggtcacataatccgagccactggacgcaaagaccgtcatagcaaagtgttcacatcaaagggtccacgtgaccggcgcgtgagactctcagctcacacggcgattcaattctacgatgtgcaagaccggttaggttatgaccggcctagcaaagccgttgattggctcatcaagaaagccaaaaccgctattgataagcttgaactcggggagactactactactactactcgtcaagaaccggtgaatactaaaccggaatctcccactttggttttccaaagagagaacaatgaccaaacgcagttcgtggcggccaatcttgatcctgaagacgcaatgaaaacgtttttcccggcgacgacaacaacaaacggtggtgggtggtacaaacatcaatttccaaaactaccctcatcaggatgacaacaacatggtctcaagaacaacaacaccaccaccaaaccttagccaagatcttggtctntntctttcacccatttcaagggamcaacmacmcagtsgtrgttcccngagaccacaatttcaccacgactcatttcgacacgttcggaagaatctctggatggaatcatcncgactttaactatgacgtcatcatcctcatcagaacatcaccancaagancaagaagaaaggagtaatggtggtttcatggtgaatcatcatcctcaccatcatcatcatcaaccgtcgatgatgacattgcttaatagtcagcaacaacaagtgtttcttggtggccaacaacancaacaacaaaggggtacccttcagtccagtttattccctcattcgtttcgttcttgggatcatcatcaaacgacgtcggatcatcatcatcatcagaatcaagcttcttcgatgtttgcttcatcatcacagtatggttctcatgggatgatgatgatgcaaggccttagtttccccaacactacaagactactccacggagaagaagctactcaaccaaactcttcttcttctcctccaaactcacacctctaaactaagacaaccatggaggttcaaattcatgatgacatgcattgaacaagaaggaggaaattaatgtgatgaatggagctagagtaagcgctatattaattagtattaccatctatccatatatttatgattcaagactattattactcatttagtgtttgttattattattcaatttgcttgtttgtttcc

SEQ ID NO: 768 - protein, 161 aa, Arabidopsis thaliana
  misc_feature (1)..(161): Ceres CLONE ID no. 248061
  misc_feature (1)..(161): Also Known As Ceres GEMINI ID no. 555G8
  misc_feature (13)..(147): Pfam Name: TCP Pfam Description:
MGLKGYSVGEGGGEIVEVQGGHIIRATGRKDRHSKVFTSKGPRDRRVRLSAHTAIQFYDVQDRLGYDRPSKAVDWLIKKAKTAIDKLELGETTTTTTRQEPVNTKPESPTLVFQRENNDQTQFVAANLDPEDAMKTFFPATTTTNGGGWYKHQFPKLPSSG

SEQ ID NO: 769 - DNA, 1422 bp, Arabidopsis thaliana
  misc_feature (1)..(1422): Ceres CLONE ID no. 261272
  misc_feature (1)..(1422): Also Known As Ceres GEMINI ID no. 539C3
attatacaaaaactgtatcatcatcatcatcaagcttgaaatcactctctttcatccttccccgcgcactgtgtctcgctctctctctcccacatttccattatctcctttctttctttctttgagaatgtcttctacaacaatcggcgagcacatcagactccgacgagctagaaaccaaacaatccgtcatctccacgccgccgacgatgatccgccgctaagccacgtcgttcttccgatttcacaacctaatcgcttctgtaactccgcaatgtcttccttctttcccctcccgacttcctcctccaacgaaagcacgaggaagaaaccgtaccaaacgtcgtcgtttcgagggatgggttgctatgccgcagcagcagcagcagctcaagaggtttctgttccctccgtcattcgctactccgcggatttggatgccagaattagaaaagataagaagaagaagaagcataagcataagaaaaagaaaaagaagaataaaggaagctacgaagatggttcgattaggattttaagcgaagaagctagagacgttattgatgtttggtgcagacctggattaggcttctccacggatgctgtaattggtcgatcggttgatcctcctcggggaaggaatattccgtcgtctcgtcgcaaaattgatgtggataacaacaattataatcacacactgggttcttctgttcttcccattcggtttctcaatcaagaaactcattctcatgatatcttcaactctgattctacttttgtgacatcatcacgcgctgaaccaacgatgttgtcaagtagatgtcgtggccatcttccacgctcttaccctgatgatcttaccgagatgaggatgctccagaatggttttgtaatgggaagaataacagattcccgtgataactaccacgaattgaggctcgatgttgatagcatgtcatacgagcaacttcttgagcttggtgatagaattggttatgtgaatactggactaaaagaaagcgagatacatcgttgtcttgggaaaatcaaaccatccgtatcacatactcttgttgatagaaaatgtagcatctgtcaggatgagtatgagagagaggatgaggttggggaattgaactgtggacacagctttcatgtccattgcgtgaaacaatggctttcgaggaagaatgcttgtccggtctgtaagaaggcagcatatggcaagccttaaaagacttttgtatctcgtcgggtttctgatagctcaagatctttcaagccaccttgctgtatagagatctgtatcatctgatacttgattcatatttgttgtttttgcatttagcaatcacaattttttttttttaagatcttatattctttgttgggtctatttatgtgattgaaatcaagagtttg

SEQ ID NO: 770 - protein, 368 aa, Arabidopsis thaliana
  misc_feature (1)..(368): Ceres CLONE ID no. 261272
  misc_feature (1)..(368): Also Known As Ceres GEMINI ID no. 539C3
  misc_feature (320)..(360): Pfam Name: zf-C3HC4 Pfam Description:
MSSTTIGEHIRLRRARNQTIRHLHAADDDPPLSHVVLPISQPNRFCNSAMSSFFPLPTSSSNESTRKKPYQTSSFRGMGCYAAAAAAAQEVSVPSVIRYSADLDARIRKDKKKKKHKHKKKKKKNKGSYEDGSIRILSEEARDVIDVWCRPGLGFSTDAVIGRSVDPPRGRNIPSSRRKIDVDNNNYNHTLGSSVLPIRFLNQETHSHDIFNSDSTFVTSSRAEPTMLSSRCRGHLPRSYPDDLTEMRMLQNGFVMGRITDSRDNYHELRLDVDSMSYEQLLELGDRIGYVNTGLKESEIHRCLGKIKPSVSHTLVDRKCSICQDEYEREDEVGELNCGHSFHVHCVKQWLSRKNACPVCKKAAYGKP

SEQ ID NO: 771 - DNA, 546 bp, Arabidopsis thaliana
  misc_feature (1)..(546): Ceres CLONE ID no. 266712
  misc_feature (1)..(546): Also Known As Ceres GEMINI ID no. 531F2
acataagtctctctcttacattttgaaaccctaatttctcaaaataaatgtctgaagttgagtaccggtgctttgtcggcggccttgcctgggccaccaatgatgaagatcttcaaaggacgttctcacagttcggcgacgttatcgattctaagatcattaacgaccgcgagagtggaagatcaaggggattcggattcgtcaccttcaaggacgagaaagccatgagggatgcgattgaagagatgaacggtaaagagctcgatggacgtgtcatcaccgtgaacgaggctcagtcgagaggtagcggcggtgatggtgaaagttacggaggcggtggtggcggctggtaatcaaagatagagttgtttgcgtgctgctgctctgtttttggtttagatttggatttgtgtcaccacttctggtttggttatcgttcgtttggtttacttttttgatgaaacagtttcgtttaagtcttctttgtctggatcgaaatgttaattcgcgtgttgtttactaaatttataacgtttccttttaacc

SEQ ID NO: 772 - protein, 101 aa, Arabidopsis thaliana
  misc_feature (1)..(101): Ceres CLONE ID no. 266712
  misc_feature (1)..(101): Also Known As Ceres GEMINI ID no. 531F2
  misc_feature (8)..(79): Pfam Name: RRM_1 Pfam Description:
MSEVEYRCFVGGLAWATNDEDLQRTFSQFGDVIDSKIINDRESGRSRGFGFVTFKDEKAMRDAIEEMNGKELDGRVITVNEAQSRGSGGDGESYGGGGGGW

SEQ ID NO: 773 - protein, 131 aa, Arabidopsis thaliana
  misc_feature (1)..(131): Ceres CLONE ID no. 27704
  misc_feature (1)..(131): Functional Homolog of  Ceres CLONE ID no. 266712 at SEQ ID NO. 772 with e-value of 8.79E-47 and percent identity of 96.0
MSEVEYRCFVGGLAWATNDEDLQRTFSQFGDVIDSKIINDRESGRSRGFGFVTFKDEKAMRDAIEEMNGKELDGRVITVNEAQSRGSGGGGGGYGSGGGGGGRGYGGGGRREGGGYGGGDGGSYGGGGGGW

SEQ ID NO: 774 - protein, 100 aa, Arabidopsis thaliana
  misc_feature (1)..(100): Ceres CLONE ID no. 102714
  misc_feature (1)..(100): Functional Homolog of  Ceres CLONE ID no. 266712 at SEQ ID NO. 772 with e-value of 7.90E-46 and percent identity of 95.0
MSEVEYRCFVGGLAWATNDEDLQRTFSQFGDVIDSKIINDRESGRSRGFGFVTFKDEKAMRDAIEEMNGKELDGRVITVNEAQSRGSGGGGGGRGGSGGG

SEQ ID NO: 775 - protein, 96 aa, Arabidopsis thaliana
  misc_feature (1)..(96): Ceres CLONE ID no. 109853
  misc_feature (1)..(96): Functional Homolog of  Ceres CLONE ID no. 266712 at SEQ ID NO. 772 with e-value of 1.39E-41 and percent identity of 94.6
MSEVEYRCFVGGLAWATNDEDLQMTFSQFGDVIDSKIINDRESGRSRGFGFVTFKDEKAMRDAIEEMNGKELDGRVITVNEAQSRGSGDSKEAMSA

SEQ ID NO: 776 - protein, 126 aa, Arabidopsis thaliana
  misc_feature (1)..(126): Public GI no. 30692254
  misc_feature (1)..(126): Functional Homolog of  Ceres CLONE ID no. 266712 at SEQ ID NO. 772 with e-value of 4.89E-46 and percent identity of 94.0
MSEVEYRCFVGGLAWATNDEDLQRTFSQFGDVIDSKIINDRESGRSRGFGFVTFKDEKAMRDAIEEMNGKELDGRVITVNEAQSRGSGGGGGGRGGSGGGYRSGGGGGYSGGGGGGYSGGGGGGGW

SEQ ID NO: 777 - protein, 108 aa, Arabidopsis thaliana
  misc_feature (1)..(108): Ceres CLONE ID no. 159471
  misc_feature (1)..(108): Functional Homolog of  Ceres CLONE ID no. 266712 at SEQ ID NO. 772 with e-value of 4.89E-46 and percent identity of 94.0
MSEVEYRCFVGGLAWATNDEDLQRTFSQFGDVIDSKIINDRESGRSRGFGFVTFKDEKAMRDAIEEMNGKELDGRVITVNEAQSRGSGGGGGGRGGSGGGYRSGGGDS

SEQ ID NO: 778 - protein, 130 aa, Arabidopsis thaliana
  misc_feature (1)..(130): Ceres CLONE ID no. 1003147
  misc_feature (1)..(130): Functional Homolog of  Ceres CLONE ID no. 266712 at SEQ ID NO. 772 with e-value of 4.89E-46 and percent identity of 94.0
MSEVEYRCFVGGLAWATNDEDLQRTFSQFGDVIDSKIINDRESGRSRGFGFVTFKDEKAMRDAIEEMNGKELDGRVITVNEAQSRGSGGGGGGRGGSGGGYRSGGGGGYSGGGGYGGGDGGSYGGGGGGW

SEQ ID NO: 779 - protein, 128 aa, Arabidopsis thaliana
  misc_feature (1)..(128): Ceres CLONE ID no. 1003205
  misc_feature (1)..(128): Functional Homolog of  Ceres CLONE ID no. 266712 at SEQ ID NO. 772 with e-value of 4.89E-46 and percent identity of 94.0
MSEVEYRCFVGGLAWATNDEDLQRTFSQFGDVIDSKIINDRESGRSRGFGFVTFKDEKAMRDAIEEMNGKELDGRVITVNEAQSRGSGGGGGGRGGSGGGYRSGGGGGYSGGGGGGYSGGGGGGYERR

SEQ ID NO: 780 - protein, 118 aa, Arabidopsis thaliana
  misc_feature (1)..(118): Ceres CLONE ID no. 117120
  misc_feature (1)..(118): Functional Homolog of  Ceres CLONE ID no. 266712 at SEQ ID NO. 772 with e-value of 4.89E-46 and percent identity of 94.0
MSEVEYRCFVGGLAWATNDEDLQRTFSQFGDVIDSKIINDRESGRSRGFGFVTFKDEKAMRDAIEEMNGKELDGRVITVNEAQSRGSGGGGGGRGGSGGGYRSGGGDGGSYGGGGGGW

SEQ ID NO: 781 - protein, 122 aa, Arabidopsis thaliana
  misc_feature (1)..(122): Ceres CLONE ID no. 16929
  misc_feature (1)..(122): Functional Homolog of  Ceres CLONE ID no. 266712 at SEQ ID NO. 772 with e-value of 4.89E-46 and percent identity of 94.0
MSEVEYRCFVGGLAWATNDEDLQRTFSQFGDVIDSKIINDRESGRSRGFGFVTFKDEKAMRDAIEEMNGKELDGRVITVNEAQSRGSGGGGGGRGGSGGGYRSGGGGGYSGGGEKNRLFYLL

SEQ ID NO: 782 - protein, 119 aa, Arabidopsis thaliana
  misc_feature (1)..(119): Ceres CLONE ID no. 1014920
  misc_feature (1)..(119): Functional Homolog of  Ceres CLONE ID no. 266712 at SEQ ID NO. 772 with e-value of 6.39E-44 and percent identity of 91.9
  misc_feature (16)..(16): Xaa is any aa, unknown, or other
  misc_feature (17)..(17): Xaa is any aa, unknown, or other
  misc_feature (54)..(54): Xaa is any aa, unknown, or other
  misc_feature (101)..(101): Xaa is any aa, unknown, or other
MSEVEYRCFVGGLAWXXNDEDLQRTFSQFGDVVDSKIINDRESGRSRGFGFVTXKDEKAMRDAIEEMNGKELDGRVITVNEAQSRGSGGGGYRSGGGGGYXGGGGGGYSGGGGGGFERR

SEQ ID NO: 783 - protein, 129 aa, Glycine max
  misc_feature (1)..(129): Ceres CLONE ID no. 1120014
  misc_feature (1)..(129): Functional Homolog of  Ceres CLONE ID no. 266712 at SEQ ID NO. 772 with e-value of 3.60E-41 and percent identity of 87.6
MSGEAEYRCFVGGLAWATADADLERTFSQFGEVIDSKIINDRETGRSRGFGFVTFKDEKSMRDAIEEMNGKELDGRTITVNEAQSRGSGGGGGGRGGGGGYRGGGGGGYGGGGGYGGGGGGYGRRDGGG

SEQ ID NO: 784 - protein, 143 aa, Brassica napus
  misc_feature (1)..(143): Ceres CLONE ID no. 1066826
  misc_feature (1)..(143): Functional Homolog of  Ceres CLONE ID no. 266712 at SEQ ID NO. 772 with e-value of 5.30E-40 and percent identity of 85.5
MSGEAEYRCFVGGLXWATADADLERTFSQFGEVIDSKIINDRETGRSRGFGFVTFKDEKSMRDAIVEMNGKELDGRTITVNEAQSRGSGGGGGGRGGGGGYRGGGGGGYGGGGGYGGGGGGYGRRDGGGYGSGGGGGYGGRRD

SEQ ID NO: 785 - protein, 103 aa, Arabidopsis thaliana
  misc_feature (1)..(103): Ceres CLONE ID no. 1012467
  misc_feature (1)..(103): Functional Homolog of  Ceres CLONE ID no. 266712 at SEQ ID NO. 772 with e-value of 1.79E-39 and percent identity of 80.8
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGGGGW

SEQ ID NO: 786 - protein, 156 aa, Nicotiana sylvestris
  misc_feature (1)..(156): Public GI no. 469070
  misc_feature (1)..(156): Functional Homolog of  Ceres CLONE ID no. 266712 at SEQ ID NO. 772 with e-value of 9.00E-38 and percent identity of 80.1
MAEVEYRCFVGGLAWATTDQTLGEAFSQFGEILDSKIINDRETGRSRGFGFVTFKDEKAMRDAIEGMNGQDLDGRNITVNEAQSRGSGGGGGGGGYRGGSGGGYGGGGRREGGYGGGGGYGGGRREGGYGGGGGGGYGGGRREGGYGGGSEGNWRS

SEQ ID NO: 787 - protein, 93 aa, Triticum aestivum
  misc_feature (1)..(93): Ceres CLONE ID no. 584963
  misc_feature (1)..(93): Functional Homolog of  Ceres CLONE ID no. 266712 at SEQ ID NO. 772 with e-value of 9.80E-32 and percent identity of 77.6
MAETEYRCFVGGLAWATDDHNLQQAFSQYGEILDAKIINDRETGRSRGFGFVTFGSEESMRQAIEEMNGKELDGRNITVNEAQSRRRRPLYPR

SEQ ID NO: 788 - protein, 99 aa, Triticum aestivum
  misc_feature (1)..(99): Ceres CLONE ID no. 934677
  misc_feature (1)..(99): Functional Homolog of  Ceres CLONE ID no. 266712 at SEQ ID NO. 772 with e-value of 1.20E-35 and percent identity of 77.5
MAETEYRCFVGGLAWATDDHNLQQAFSQYGEILDAKIINDRETGRSRGFGFVTFGSEESMRQAIEEMNGKELDGRNITVNEAQSRRSGGGYGGQGGGGY

SEQ ID NO: 789 - protein, 112 aa, Triticum aestivum
  misc_feature (1)..(112): Ceres CLONE ID no. 751438
  misc_feature (1)..(112): Functional Homolog of  Ceres CLONE ID no. 266712 at SEQ ID NO. 772 with e-value of 3.49E-36 and percent identity of 77.0
MAETEYRCFVGGLAWATDDNNLQQAFSQYGEILDAKIINDRETGRSRGFGFVTFGSEESMRQAIEEMNGKELDGRNITVNEAQSRRSGGGGGGGGYGGQRGGGGGYGGGGGG

SEQ ID NO: 790 - protein, 96 aa, Triticum aestivum
  misc_feature (1)..(96): Ceres CLONE ID no. 702509
  misc_feature (1)..(96): Functional Homolog of  Ceres CLONE ID no. 266712 at SEQ ID NO. 772 with e-value of 4.29E-31 and percent identity of 76.4
MAETEYRCFVGGLAWATDDHNLQQAFSQYGEILDAKIINDRETGRSRGFGFVTFGSEESMRQAIEXMNGKELDGRNITVNEAQSRRRLLFGLPXLE

SEQ ID NO: 791 - protein, 111 aa, Triticum aestivum
  misc_feature (1)..(111): Ceres CLONE ID no. 726494
  misc_feature (1)..(111): Functional Homolog of  Ceres CLONE ID no. 266712 at SEQ ID NO. 772 with e-value of 2.39E-37 and percent identity of 76.2
MAETEYRCFVGGLAWATDDHNLQQAFSQYGEILDAKIINDRETGRSRGFGFVTFGSEESMRQAIEEMNGKELDGRNITVNEAQSRRFGGGGGGGGGYGGGGGGYGGQRGGG

SEQ ID NO: 792 - protein, 129 aa, Triticum aestivum
  misc_feature (1)..(129): Ceres CLONE ID no. 786742
  misc_feature (1)..(129): Functional Homolog of  Ceres CLONE ID no. 266712 at SEQ ID NO. 772 with e-value of 1.50E-35 and percent identity of 76.0
  misc_feature (128)..(128): Xaa is any aa, unknown, or other
MAETXYRCFVGGLAWATDDNNLQQAFSQYGEILDAKIINDRETGRSRGFGFVTFGSEESMRQAIEEMNGKELDGRNITVNEAQSRRSGGGGGGGGYGGQRGGGGGYGGGGGGYGGQGGGGYGQGGGGXY

SEQ ID NO: 793 - protein, 137 aa, Catharanthus roseus
  misc_feature (1)..(137): Public GI no. 6911142
  misc_feature (1)..(137): Functional Homolog of  Ceres CLONE ID no. 266712 at SEQ ID NO. 772 with e-value of 3.59E-34 and percent identity of 75.7
MASADVEFRCFVGGLAWATTDQSLSEAFSQYGEVLESKIINDRETGRSRGFGFVTFGDEKSMKDAIEGMNGQTLDGRNVTVNEAQSRGSGGGGGGGGFRGPRREGGGCYGGGGRRNGGYGGNGGGYGGGRRDGGRRW

SEQ ID NO: 794 - protein, 94 aa, Triticum aestivum
  misc_feature (1)..(94): Ceres CLONE ID no. 928422
  misc_feature (1)..(94): Functional Homolog of  Ceres CLONE ID no. 266712 at SEQ ID NO. 772 with e-value of 1.70E-29 and percent identity of 75.6
MAETEYRCFVGGLAWATDDHNLQQAFSQYGEILDAKIINDRETGRSRGFGFVTFGSEESMRQAIEEMNGKELDGRNITVXEAXVPPLDQLASSN

SEQ ID NO: 795 - protein, 95 aa, Triticum aestivum
  misc_feature (1)..(95): Ceres CLONE ID no. 771071
  misc_feature (1)..(95): Functional Homolog of  Ceres CLONE ID no. 266712 at SEQ ID NO. 772 with e-value of 8.79E-31 and percent identity of 75.2
MAETEYRCFVGGLAWATDDHNLQQAFSQYGEILDAKIINDRETGRSRGFGFVTFGSEESMRQAIEEMNGKELDGRNITVNEAPARRLRRHASPAA

SEQ ID NO: 796 - protein, 103 aa, Triticum aestivum
  misc_feature (1)..(103): Ceres CLONE ID no. 1017780
  misc_feature (1)..(103): Functional Homolog of  Ceres CLONE ID no. 266712 at SEQ ID NO. 772 with e-value of 1.20E-35 and percent identity of 75.0
MAETEYRCFVGGLAWATDDHNLQQAFSQYGEILDAKIINDRETGRSRGFGFVTFGSEESMRQAIEEMNGKELDGRNITVNEAQSRRSGGGGGGGGYGGQRGGX

SEQ ID NO: 797 - protein, 88 aa, Triticum aestivum
  misc_feature (1)..(88): Ceres CLONE ID no. 617277
  misc_feature (1)..(88): Functional Homolog of  Ceres CLONE ID no. 266712 at SEQ ID NO. 772 with e-value of 2.99E-30 and percent identity of 75.0
MAETEYRCFVGGLAWATDDHNLQQAFSQYGEILDAKIINDRETGRSRGFGFVTFGSEESMRQAIEXMNGKELDGRNITVNEAQALIHE

SEQ ID NO: 798 - DNA, 891 bp, Zea mays
  misc_feature (1)..(891): Ceres CLONE ID no. 284030
  misc_feature (1)..(891): Also Known As Ceres GEMINI ID no. 552H9
  misc_feature (557)..(557): n is a, c, t, g, unknown, or other
atccccatccactctactttacaccgcagcagtgagccagccactgagccaccaagttaactctgagcgacgtcaagcaccaacgcacgacgaccaccaccaccacctcgagctacaagctatggcgaacgtctcctccgctcttcgtcccttcctctggccctggtgccgccgccgctgctgcttctcctggtagcgggatcgctcgcaggggcaaccgcgcttggcagcttccctggggaacgtcgtggtcgaagcctgcagcagctgccaaacccgatgcctcagcctgtcccgcagccgcagccagacccaaacgtacggccgcaaccggggtcgccgaacccactgccaccacagcccctgccgcaaccaaatccaaaccctcagccgcagccccttccgcaaccacagccaggcccgcagcctgacccaaacccacaacctcaacctcagcctcagcctctcccgcagccacagcctggcccaatcccgccgcagcctgacccgaaccggaaccbacagccacaacytcaacccttgccacagcytctccngcaaccacagcctggcccgatcccacagcctaacccaaacccaaacccacagcccgtgccgatgccagacccaaatgtgcagcagccacaaccacaacctgctcccaaccaaaatccacagccgcagtctgatcagctctccgggggtccacagccacttcccaacagcgaaccaaggatgttgaacccgcaatacgccatgcttttaagctttgctgctttgctactataatagctctataccatacagtagtttttttcgttgttttcttttacgcttgtataaatataataatatatatgcggagtagtattattattgtgattttttctt

SEQ ID NO: 799 - protein, 169 aa, Zea mays
  misc_feature (1)..(169): Ceres CLONE ID no. 284030
  misc_feature (1)..(169): Also Known As Ceres GEMINI ID no. 552H9
  misc_feature (81)..(81): Xaa is any aa, unknown, or other
  misc_feature (85)..(85): Xaa is any aa, unknown, or other
  misc_feature (91)..(91): Xaa is any aa, unknown, or other
  misc_feature (93)..(93): Xaa is any aa, unknown, or other
MPQPVPQPQPDPNVRPQPGSPNPLPPQPLPQPNPNPQPQPLPQPQPGPQPDPNPQPQPQPQPLPQPQPGPIPPQPDPNRNXQPQXQPLPQXLXQPQPGPIPQPNPNPNPQPVPMPDPNVQQPQPQPAPNQNPQPQSDQLSGGPQPLPNSEPRMLNPQYAMLLSFAALLL

SEQ ID NO: 800 - DNA, 1318 bp, Zea mays
  misc_feature (1)..(1318): Ceres CLONE ID no. 333618
  misc_feature (1)..(1318): Also Known As Ceres GEMINI ID no. 538H7
ctcgccgcccccgtctcctctcctctcctctcccccgcatccacggccgcaggccgcagccagccactcgacgatctagtcgtctctctctccccgctctgccgcctcgctgccgcggcttcccgtcggctggaggatgaaggtcacggtcgtgtcccggagcggccgggaggtcgtcaagggcggcatcgacctcaaggactcggccaaggtcgcggacctgcaggaggccatccatgccaggactaagaagtattatccttctaggcagcggctcaccctcccccttcaacctggaaaaggcgggaagccagttgtcctcagtccgaaggccagcctgctagaatactgcgagaagggttctgggtcactgacagtggtcttcaaagatttagggccacaggtctactacagcacactgttcttcttcgagtacctgggtcctctcatcatctaccccatgttctactatctgcctgtctacaaatacttcgggtacgagggggagcgggccatgcaccctgtccagacctacgccatgtactactggtgcttccactacttcaagcggatcatggagacattcttcgtgcaccgcttcagccacgcgacgtcgccgctctcgaacgtcttcaggaactgtgcctactactggaccttcggcgcctacattgcttactactgcaaccacccgctgtacaccccagtgagtgatctgcagatgaagattgggtttggttttggggtcgtctgccaggtcgcgaacttctactgccacatcctgctgcggaacctcaggagcccaagcggcagcggcgggtaccagatcccccgcggtttcttgttcaacatcgtgacctgcgccaattacaccaccgagatctatcagtgggtcggcttcaacatcgccacgcagaccgtggcaggttacgtcttccttgtcgtggcggcaggcatcatgaccaactgggcgctcggcaagcacagccgtctgaagaagctgtttgacggcaaggatgggaggcccaagtaccctcgccggtgggtgattctccctccgttcctgtgaagaggtggtgggtggtcggcctattgtgattcgatgtctacagacagttgtactgtactaatcgtgcctgtttagcggttgaacttggattccgttgtccgaaatttctaatccgaaagatggatttcattgtcttcttcttcttagcattatgtcactatctcacgtcgtcctgtctcaatacagtctaaggttcatgtgatgttatccccatttgtccacgcacaagtgaatgcagtcactatttcg

SEQ ID NO: 801 - protein, 310 aa, Zea mays
  misc_feature (1)..(310): Ceres CLONE ID no. 333618
  misc_feature (1)..(310): Also Known As Ceres GEMINI ID no. 538H7
  misc_feature (158)..(310): Pfam Name: Steroid_dh Pfam Description:
MKVTVVSRSGREVVKGGIDLKDSAKVADLQEAIHARTKKYYPSRQRLTLPLQPGKGGKPVVLSPKASLLEYCEKGSGSLTVVFKDLGPQVYYSTLFFFEYLGPLIIYPMFYYLPVYKYFGYEGERAMHPVQTYAMYYWCFHYFKRIMETFFVHRFSHATSPLSNVFRNCAYYWTFGAYIAYYCNHPLYTPVSDLQMKIGFGFGVVCQVANFYCHILLRNLRSPSGSGGYQIPRGFLFNIVTCANYTTEIYQWVGFNIATQTVAGYVFLVVAAGIMTNWALGKHSRLKKLFDGKDGRPKYPRRWVILPPFL

SEQ ID NO: 802 - DNA, 1384 bp, Zea mays; identical to SEQ ID NO: 390
  misc_feature (1)..(1384): Ceres CLONE ID no. 336888
  misc_feature (1)..(1384): Also Known As Ceres GEMINI ID no. 538H7
  misc_feature (1)..(1384): Also Known As Ceres CDNA ID no. 23767148
  misc_feature (1)..(1384): Also Known As Ceres GEMINI ID no. 538H7

SEQ ID NO: 803 - protein, 271 aa, Zea mays; identical to SEQ ID NO: 391
  misc_feature (1)..(271): Ceres CLONE ID no. 336888
  misc_feature (1)..(271): Also Known As Ceres CDNA ID no. 23767148
  misc_feature (1)..(271): Also Known As Ceres GEMINI ID no. 538H7
  misc_feature (1)..(271): Also Known As Ceres GEMINI ID no. 538H7
  misc_feature (56)..(101): Pfam Name: zf-C3HC4 Pfam Description:

SEQ ID NO: 804 - DNA, 1108 bp, Zea mays
  misc_feature (1)..(1108): Ceres CLONE ID no. 343205
  misc_feature (1)..(1108): Also Known As Ceres GEMINI ID no. 538A10
cccgcaactgcagatccccaattcgtttatttcttcccaccgagccaagctgcgacgacggcggtcgcagcgtcgccttccctccctccgtaccgccgacgccgacgagcatattgagccgagcgcccgagcacctctcctgtcagcagcggcactcgccattccaagtacgaggtcgacgcgctgtggggcttgctgaaacgagcaggtctacccccaagtgaaatcagggtcttcaagatagcttactgagatgtggggttttgcatcaaacgcttgggcagctgggctggagaagaggagttccccaaaccgcacttcctcgagtgctgcttattctgacgacgaagcatcctcgtgcacaagcagggaagaaggcctggagtgcccgatatgttgggagtctttcaacatagtggagaatgtgccttatgcgctatggtgcggacacaccatgtgcaagaactgcatcctagggcttcaatgggccgtcatcaaagtcccaaccgtgccgatccagctaccgttcttcatctgctgtccctggtgcaacctcctgtcgccccgcgtactttacaaggggaacctcacgttcccacgaaagaactatttcctcctctggatggtcgaggggatgaacggcgagcgggccagatcacgcccagctattcgcagcgagcagcatactccgtggctctcaagcagcagcagcgtggcaaatggaaatgcaggctgttcaaatcccactcgacgccacctcccgccaccatctgttgacacttcgcccaccaacgcaaatcatgccaactacggggggtcccctctgctgaacgcagggagggaaatggctaccaagtaccaacgtgaaggcagttggaatttggagggctggatgggtcggaggcagtgggaagagaaggttgtcagaattggttcggcaggtgtctaataaaggcttcctgttgggaaagaattggatccacgggcagcttttagtcatttgtttggaggcattggattcattggagggtcgatttgtgattgtaatcacgattaatgtaatggattggaaattcggaaggggccagatctctttttcatacaaatc

SEQ ID NO: 805 - protein, 231 aa, Zea mays
  misc_feature (1)..(231): Ceres CLONE ID no. 343205
  misc_feature (1)..(231): Also Known As Ceres GEMINI ID no. 538A10
MWGFASNAWAAGLEKRSSPNRTSSSAAYSDDEASSCTSREEGLECPICWESFNIVENVPYALWCGHTMCKNCILGLQWAVIKVPTVPIQLPFFICCPWCNLLSPRVLYKGNLTFPRKNYFLLWMVEGMNGERARSRPAIRSEQHTPWLSSSSSVANGNAGCSNPTRRHLPPPSVDTSPTNANHANYGGSPLLNAGREMATKYQREGSWNLEGWMGRRQWEEKVVRIGSAGV

SEQ ID NO: 806 - DNA, 2887 bp, Zea mays
  misc_feature (1)..(2887): Ceres CLONE ID no. 362993
  misc_feature (1)..(2887): Also Known As Ceres GEMINI ID no. 539D9
gactcacactcacacagcaaataccccacaaggccactccaaagagctagtagtggaaccgaagatgttcgggaacatcggaaagatccccatcatcggcgacctgacgggcagcaacaagaatgcgcacctcaagggcaacgtggtgctcgtgcgcaagaccgtgctcggcttggacgtcaccagcatcgccggctccctcctcgacggcgtcggcgagttcctcggccgcggcgtcacctgccagcttatcagctccaccgtcgtggaccctaacaacggcaaccgcgggaagttgggcgccgaggcgagcctggagcagtggctgctgaacccgccgccgcttctgtccagcgagaaccagttccgcgtcaccttcgactgggaggtggagaagcagggcatcccgggcgccatcatcgtcaagaacaaccacgcctccgagttcttcctcaagaccatcaccctcaacgacgtccccggccacggcaccatcgtcttcgtcgccaactcatggatctacccgcagtccaagtaccgctacaaccgcgtcttcttctccaacgacacgtacctccccagccagatgccggcggcgctgaagccctaccgcgacgacgagctccggaacctgaggggcgacgaccagcagggcccgtaccaggagcacgaccgcgtctaccgctacgacgtctacaacgacctcggcctgcctgacagcgggaacccgcgccccgtcctcggcggcaccaaggagctcccctacccgcgccgctgccgcaccgggcggaagcccaccaagagcgaccccaacagcgagagcaggctcacgctggtcgacggcgacgtctacgtgccgcgcgacgagcgcttcggccacatcaagaagtcggacttctacggctacgccatcaaggcgctggtgaacgccgtcatcccggcaatccgcacctacgtcgacctgtcgcccggcgagttcgactccttcaaggacatcatgaagctgtacgagggcgggatccagctgcccaaaataccagccctcgaggacctgcggaagcagttcccactcgagctcgtcaaggatgtcctcccggtcggcggcgactacctcctcaagctccccatgccgcagatcatcaaagaggacaagacaggttggatgacagatgaggagtttggacgggagattctcgccggcgtgaaccccttgctcgtcaagcgtctcacggagttccctccgaggagcagtcttgacccgagcaagtacggcgaccacaccagcaccatcagggaggcggacctcgagaacaagctcgagggcctgaccgtgcagcaggcgctgcacggcaaccggctctacatcctggaccaccacgacaacttcatgccgttcctggtcagggtgaacagcctggagggcaacttcatctacgccaccaggaccgtgctgttcctgcgcggcgacggcacgctggtgccggtggccatcgagctgagcctgcccgagctccgggacggcctgatcaccgccaagagctccgtgtacacgcccaagtcgaccaccggcgcggaggcgtgggtgtggcacctggccaaggcctacgccaacgtgaacgactactgctggcaccagctcatcagccactggctcaacacccacgccgtgatggagccgttcgtgatcgccaccaaccggcagctcagcgtgacgcaccccgtgcacaagctcctcctgccgcactaccgtgacaccatgaacatcaactccaacgctcgccagatgctcgtcaacgccggcggcatcttcgagaccaccgtcttcccgcgccagtacgcgttcgagatgtcctccgtcatctacaaggactggaacttcacagagcaggctctccctgacgacctaatcaagagaggcatggcggttgccgacccgtcgagcccgtacaaggtacggctgctggtggaggactacccgtacgcgtcggacgggctggccatctggcacgccatcgagcagtgggtgacggagtacctcgccgtctactaccccaacgacggcgtgctgcgggcggacgtggagctgcaggcgtggtggaaggaggcgcacgaggtcgggcacgccgacctcaaggacgcgccctggtggcccaagatgcagaccgtggccgagctggtcaaggcctgcaccaccatcatctggatcgcgtcggcgctccacgcggccgtcaacttcgggcagtacccatacgccgggtacctcccgaaccgcccgtccgtcagccggaagccgatgccggcgccgggcagcgacgagtacgcggagctggagcgcaagccggagaaggtgttcgtgcgcaccatcaccagccagttccaggccctcgtcggcatctcgctgctggagatcctgtccagccactcctccgacgaggtgtacctcggccagcgcgacaccaaggagtggacgtcggacgccaaggcgcaggaggcgttcaagcggttcggcgcgcggctgaccgagatcgagaaacgcgtcgtcaccatgaacgcggaccctcgcctcaagaaccgcaacggcccggccgagttcccctacacgctgctctaccccaacacctccgacacgaagggcgacgccgccggcatcaccgccaagggcattccaaacagcatctccatttgagttttgtctgtctgagctgaggacgtacggtcgtcgcactagttgtttgcgtttccccgttccgttccgtgaagtgtggttctcacttgcgcggtattgtgcaaatagccaagtacttactccttacggaagtcgctacgtgaggactgttgtaataaggctctattcagttcctcaataatgaagttactttgtgtttcg

SEQ ID NO: 807 - protein, 873 aa, Zea mays
  misc_feature (1)..(873): Ceres CLONE ID no. 362993
  misc_feature (1)..(873): Also Known As Ceres GEMINI ID no. 539D9
  misc_feature (176)..(851): Pfam Name: Lipoxygenase Pfam Description: Lipoxygenase
  misc_feature (58)..(164): Pfam Name: PLAT Pfam Description:
MFGNIGKIPIIGDLTGSNKNAHLKGNVVLVRKTVLGLDVTSIAGSLLDGVGEFLGRGVTCQLISSTVVDPNNGNRGKLGAEASLEQWLLNPPPLLSSENQFRVTFDWEVEKQGIPGAIIVKNNHASEFFLKTITLNDVPGHGTIVFVANSWIYPQSKYRYNRVFFSNDTYLPSQMPAALKPYRDDELRNLRGDDQQGPYQEHDRVYRYDVYNDLGLPDSGNPRPVLGGTKELPYPRRCRTGRKPTKSDPNSESRLTLVDGDVYVPRDERFGHIKKSDFYGYAIKALVNAVIPAIRTYVDLSPGEFDSFKDIMKLYEGGIQLPKIPALEDLRKQFPLELVKDVLPVGGDYLLKLPMPQIIKEDKTGWMTDEEFGREILAGVNPLLVKRLTEFPPRSSLDPSKYGDHTSTIREADLENKLEGLTVQQALHGNRLYILDHHDNFMPFLVRVNSLEGNFIYATRTVLFLRGDGTLVPVAIELSLPELRDGLITAKSSVYTPKSTTGAEAWVWHLAKAYANVNDYCWHQLISHWLNTHAVMEPFVIATNRQLSVTHPVHKLLLPHYRDTMNINSNARQMLVNAGGIFETTVFPRQYAFEMSSVIYKDWNFTEQALPDDLIKRGMAVADPSSPYKVRLLVEDYPYASDGLAIWHAIEQWVTEYLAVYYPNDGVLRADVELQAWWKEAHEVGHADLKDAPWWPKMQTVAELVKACTTIIWIASALHAAVNFGQYPYAGYLPNRPSVSRKPMPAPGSDEYAELERKPEKVFVRTITSQFQALVGISLLEILSSHSSDEVYLGQRDTKEWTSDAKAQEAFKRFGARLTEIEKRVVTMNADPRLKNRNGPAEFPYTLLYPNTSDTKGDAAGITAKGIPNSISI

SEQ ID NO: 808 - DNA, 1904 bp, Zea mays
  misc_feature (1)..(1904): Ceres CLONE ID no. 382867
  misc_feature (1)..(1904): Also Known As Ceres GEMINI ID no. 539C10
ttccctgttcctcgtacgtagtgtagcaccaaggagccaaaggtttgcacctcgatcgatctctaaaatcttctcctttttactctgatgaagataaccgtgttgttgctagtactagcagcagccagcggggcagctgagcgagcatggtgaagatctgctgcatcggcgcggggtacgtgggcgggccgacgatggcggtgatcgcgctcaagtgcccggccatcgaggtggtggtggtggacatctcggagccgcgcatcgccgggtggaacagcgagcgcctccccatctacgagcccggcctggacgacgtcgtgaggcagtgccgcggccgcaacctcttcttcagcaccgaggtgcaccgccacgtgggcgacgccgacatcgtcttcgtctccgtcaacaccccgaccaagacctgcggccttggcgccggcaaggccgccgacctcacctactgggagagcgcggcgcgcatgatcgccgacgtctcccgctccgacaagatcgtggtggagaagtccacggtgcccgtcaagacggcggaggccatcgagaagatcctggtgcacaacagccgcggcgtgcgctaccagatcctgtccaacccggagttcctggcggagggcaccgccgtgcaggacctgttcgcgcccgaccgcgtgctcatcggcggccgcgagacccccgagggccgcgccgccgtcgccaggctcagggacgtgtacgcgcagtgggtgcccggggaccgcatcatcaccaccaacctctggtccgccgagctgtccaagctcgccgccaacgccttcctggcgcagcgcatctcctccgtcaacgccatctccgcgctctgcgaggccacgggcgccgacgtcaccgaggtggcgcactccgtcggcagggacgcgcgcatcggcccgcgcttcctctccgccagcgtcggcttcggcggctcctgcttccagaaggacatcctcaacctcgtctacatctgcgagtgctacggcctccccgaggtggccgcctactggcgggaagtcatccggatcaacgaccaccagaagagccgcttcgtcaaccgcgtcgtctcctccatgttcaacaccgtcgccggcaagaagatcgccgtgctcggcttcgccttcaagaaggacacgggggacacccgcgagacgcccgccatcgacgtctgcaacggcctgctcggggacaaggctgtcatcagcatctacgacccgcaggtcacgggggagcaggtgtcgcgggacctcgccatgaacaagttcgactgggaccacccgcgccacctgcagccgctcagcgccaccgacctggccaagcaggtcgccgtcgcgcccgacgcctacgaggccgctcgcgacgcgcacgccgtctgcatcctcaccgagtgggacgaattcaggacgctcgactacaagcgcatgttcgacgccatgcacaagccagccttcatcttcgacggccgcaacgtcgtcgaccccgccaagctccgggagatcggcttcgtcgtctacgctatcggcaagccgctcgacgattggctcaaggacatgccagccgtcgcgtgatccatcgatccatctgtagggcgcattccttgacatgcggccccatgcatccatctttcttcatcctccctctcatccgattcggctattcatcagtatattaattaggtttccctgttaatttcattgtggtctttaattcacagtttttttacaagttagctcgatcgatatgccgacatgttttatacttaggtagtatatagaatctttttgcatacatgcacggagtactaatgatatataaattttgaattgtttgtagctttatttatatacattggcaaagcattgatgctgtttcttgtcacg

SEQ ID NO: 809 - protein, 481 aa, Zea mays
  misc_feature (1)..(481): Ceres CLONE ID no. 382867
  misc_feature (1)..(481): Also Known As Ceres GEMINI ID no. 539C10
  misc_feature (2)..(200): Pfam Name: UDPG_MGDP_dh_N Pfam Description:
  misc_feature (209)..(306): Pfam Name: UDPG_MGDP_dh Pfam Description:
  misc_feature (328)..(453): Pfam Name: UDPG_MGDP_dh_C Pfam Description:
MVKICCIGAGYVGGPTMAVIALKCPAIEVVVVDISEPRIAGWNSERLPIYEPGLDDVVRQCRGRNLFFSTEVHRHVGDADIVFVSVNTPTKTCGLGAGKAADLTYWESAARMIADVSRSDKIVVEKSTVPVKTAEAIEKILVHNSRGVRYQILSNPEFLAEGTAVQDLFAPDRVLIGGRETPEGRAAVARLRDVYAQWVPGDRIITTNLWSAELSKLAANAFLAQRISSVNAISALCEATGADVTEVAHSVGRDARIGPRFLSASVGFGGSCFQKDILNLVYICECYGLPEVAAYWREVIRINDHQKSRFVNRVVSSMFNTVAGKKIAVLGFAFKKDTGDTRETPAIDVCNGLLGDKAVISIYDPQVTGEQVSRDLAMNKFDWDHPRHLQPLSATDLAKQVAVAPDAYEAARDAHAVCILTEWDEFRTLDYKRMFDAMHKPAFIFDGRNVVDPAKLREIGFVVYAIGKPLDDWLKDMPAVA

SEQ ID NO: 810 - protein, 466 aa, Oryza sativa subsp. japonica
  misc_feature (1)..(466): Public GI no. 50582697
  misc_feature (1)..(466): Functional Homolog of  Ceres CLONE ID no. 382867 at SEQ ID NO. 809 with e-value of 6.89E-221 and percent identity of 88.5
MAVIALKCPDVEVVVVDISAPRIEGWNSERLPIYEPGLDDVVRQCRGRNLFFSTDVERHVADAGIVFVSVNTPTKTRGLGAGKAADLTYWESAARIIADVSRSDKIVVEKSTVPVKTAEAIEKILAHNSKGGNIRYQILSNPEFLAEGTAIQDLFSPDRVLIGGRETPEGRAAVAALKSIYARWVPDDRIITTNLWSAELSKLAANAFLAQRISSVNAISALCEATGADVTEVANSIGKDSRIGPRFLSASVGFGGSCFQKDILNLVYICECYGLPEVANYWHQVIRINDYQKSRFVNRVVSSMFNTVAGKKVAVLGFAFKKDTGDTRETPAIDVCKGLVGDKAVVSIYDPQVTEEQVQRDLVMNKFDWDHPRHLQPMSPSSAKHVAVSWDAYEAARGAHAVCILTEWDEFRRLDYQRMYDAMHKPAFLFDGRNVVDPDKLRRIGFVVYSIGKPLDHWLRDMPAVA

SEQ ID NO: 811 - protein, 480 aa, Cinnamomum osmophloeum
  misc_feature (1)..(480): Public GI no. 40317278
  misc_feature (1)..(480): Functional Homolog of  Ceres CLONE ID no. 382867 at SEQ ID NO. 809 with e-value of 1.49E-218 and percent identity of 82.2
MVKICCIGAGYVGGPTMAVIALKCPSIEVVVVDISVARIAAWNSEQLPIYEPGLDDVVKQCRGRNLFFSTDIEKHISEADIIFVSVNTPTKTRGLGAGKAADLTYWESAARMIADVSKSDKIVVEKSTVPVKTAEAIEKILTHNSRGINFQILSNPEFLAEGTAIEDLFKPDRVLIGGRETPEGQKAIKTLKDVYAHWVPEDRILATNLWSAELSKLAANAVLAQRISSINAMSALCEATGADVTEVAYAVGKDSRIGPKFLNASVGFGGSCFQKDILNLVYICECNGLPEVANYWKQVIKINDYQKNRFVNRVVASMFNTVSGKKIAVLGFAFKKDTGDTRETPAIDVCKGLLGDKAKISIYDPQVTEDQIQRDLAMNKFDWDHPIHLQPMSPTTVKQVSVTWDAYEATKDAHGVCILTEWDEFKALDYQKIYDNMQKPAFVFDGRNIVDVEKLRKIGFIVFSIGKPLDPWLKDMPAVA

SEQ ID NO: 812 - protein, 524 aa, Nicotiana tabacum
  misc_feature (1)..(524): Public GI no. 48093459
  misc_feature (1)..(524): Functional Homolog of  Ceres CLONE ID no. 382867 at SEQ ID NO. 809 with e-value of 3.20E-216 and percent identity of 81.9
MVKICCIGAGYVGGPTMAVIALKCPSIEVAVVDISVPRITAWNSDQLPIYEPGLEDVVKECRGRNLFFSTDVEKHVREADIVFVSVNTPTKTRGLGAGKAADLTYWESAARMIADVSKSDKIVVEKSTVPVKTAEAIEKILTHNSKGINFQILSNPEFLAEGTAIEDLFKPDRVLIGGRETPGGQKAIQALKDVYAQWVPEDRILTTNLWSAELSKLAANAFLAQRISSVNAMSALCEATGANVSQVAYAVGKDSRIGPKFLNASVGFGGSCFQKDILNLVYICECNGLPEVAEYWKQVIKINDYQKTRFVNRVVASMFNTVSGKKVAVLGFAFKKDTGDTRETPAIDVCKGLLGDKAKLSIYDPQVNEDQIQRDLSMNKFDWDHPLHLQPMSPTTVKQVSVVWDAYTATKDAHAVCILTEWDEFKTLDYQKIYDNMQKPAFIFDGRNVVDMEKLREIGFIVYSIGKPLDAWLKDMPLSLNCITWLEWLCSDIKDISYMRQSAGILTIFFFYHVQFCFVLSHVG

SEQ ID NO: 813 - protein, 480 aa, Glycine max
  misc_feature (1)..(480): Public GI no. 6136119
  misc_feature (1)..(480): Functional Homolog of  Ceres CLONE ID no. 382867 at SEQ ID NO. 809 with e-value of 4.09E-216 and percent identity of 81.6
MVKICCIGAGYVGGPTMAVIALKCPSIEVAVVDISKSRIAAWNSDQLPIYEPGLDGVVKQCRGKNLFFSTDVEKHVFEADIVFVSVNTPTKTQGLGAGKAADLTYWESAARMIADVSKSDKIVVEKSTVPVKTAEAIEKILTHNSKGIKFQILSNPEFLAEGTAIKDLFNPDRVLIGGRETPEGQKAIQTLKDVYAQWVPEERILTTNLWSAELSKLAANAFLAQRISSVNAMSALCEATGANVQQVSYSVGTDSRIGPKFLNASVGFGGSCFQKDILNLVYICECNGLPEVAEYWKQVIKINDYQKSRFVNRVVASMFNTVSNKKIAILGFAFKKDTGDTRETPAIDVCQGLLGDKANLSIYDPQVTEDQIQRDLSMNKFDWDHPIHLQPTSPTTVKKVSVVWDAYEATKDAHGLCILTEWDEFKTLDYQKIFDNMQKPAFVFDGRNIVDADKLREIGFIVYSIGKPLDPWLKDMPAVA

SEQ ID NO: 814 - DNA, 1446 bp, Populus balsamifera subsp. trichocarpa
  misc_feature (1)..(1446): Ceres GDNA ANNOT ID no. 1450213
  misc_feature (1)..(1446): Functional Homolog of  Ceres CLONE ID no. 382867 at SEQ ID NO. 809 with e-value of 3.20E-216 and percent identity of 81.4
atggtgaagatctgttgcattggagcagggtatgtcggtgggcctacaatggctgtcatcgcactcaagtgcccgtcaattgaagtggtggttgttgacatctgggaacctaggattgcagcctggaacagtgaccagctccccatctatgagccaggcctttatgatgtggtgaaggagtgccgaggcaggaatctcttcttcagcaaagatgtggagaagcatgtcgcagaggctgatatagtttttgtttcggtcaacacccctaccaaaactcaaggtcttggagcgggcaaagctgcagatctgacgtactgggagagcgcagcacgcacaattgctgatgtgtccaaatctgacaaaatcgttgttgagaaatcaacagtcccagttaaaactgccgaggcaattgaaaagatcttgacccacaacagtaaggggatcaaattccagatcctctcaaaccctgagttccttgcagaaggaactgcaatcggtgatctgtttcaacctgatcgtgtcctcattggagggagggaaaccccagaaggccagaaggcaatccaagcattgaaggatgtgtatgctcattgggttcctgaagaccgcatcctaaccaccaacctttggtctgcagagctgtccaagcttgctgccaatgcctttttggcccaaaggatttcctccgttaatgccatgtcagcactctgtgaggcaactggggctgatgttgccgaggtggcctatgctgttggaaaggattcaaggattggtcccaagttcttgaatgctagtgttggttttggtgggtcctgcttccagaaggatattctgaatcttgtttacatctgcgagtgcaatggccttccagaggtggcagagtactggaaacaagtcatcaagatcaatgattaccagaagagccgatttgtgaaccgtgttgtttcatctatgtttaacacagtctctcaaaagaagattgccattttagggttcgctttcaagaaggatactggcgacactagggagacccctgccattgatgtgtgccagggactgttgggagacaaggctctcttgagcatatatgatccacaggtccagaaagaacatattcagagggatcttatcatgaaaaagtttgattgggatcatcctctccatctccagccgaagagtgccagctctgctgttgagcaagtgactgttacttctgatgcctatgaggcaacaaaggaagcccatggcgtttgcatcttgacagagtgggatgaattcaagactcttgattacaagaagatatatgacaacatgcagaaaccagcttttgtgtttgatggaaggaatgttgtgaatgcagataagctgagggagattggtttcattgtgtactccattggtaagccactggatgcatggctcaaggacatgcctgctatcgcataa

SEQ ID NO: 815 - protein, 481 aa, Populus balsamifera subsp. trichocarpa
  misc_feature (1)..(481): Ceres GDNA ANNOT ID no. 1450213
  misc_feature (1)..(481): Functional Homolog of  Ceres CLONE ID no. 382867 at SEQ ID NO. 809 with e-value of 3.20E-216 and percent identity of 81.4
MVKICCIGAGYVGGPTMAVIALKCPSIEVVVVDIWEPRIAAWNSDQLPIYEPGLYDVVKECRGRNLFFSKDVEKHVAEADIVFVSVNTPTKTQGLGAGKAADLTYWESAARTIADVSKSDKIVVEKSTVPVKTAEAIEKILTHNSKGIKFQILSNPEFLAEGTAIGDLFQPDRVLIGGRETPEGQKAIQALKDVYAHWVPEDRILTTNLWSAELSKLAANAFLAQRISSVNAMSALCEATGADVAEVAYAVGKDSRIGPKFLNASVGFGGSCFQKDILNLVYICECNGLPEVAEYWKQVIKINDYQKSRFVNRVVSSMFNTVSQKKIAILGFAFKKDTGDTRETPAIDVCQGLLGDKALLSIYDPQVQKEHIQRDLIMKKFDWDHPLHLQPKSASSAVEQVTVTSDAYEATKEAHGVCILTEWDEFKTLDYKKIYDNMQKPAFVFDGRNVVNADKLREIGFIVYSIGKPLDAWLKDMPAIA

SEQ ID NO: 816 - protein, 481 aa, Populus tomentosa
  misc_feature (1)..(481): Public GI no. 39939262
  misc_feature (1)..(481): Functional Homolog of  Ceres CLONE ID no. 382867 at SEQ ID NO. 809 with e-value of 3.69E-215 and percent identity of 81.0
MVKICCIGAGYVGGPTMAVIALKCPSIEVVVVDIWEPRIAAWNSDQLPIYEPGLYDVVKECRGRNLFFSKDVEKHVAEADIVFVSVNTPTKTQGLGAGKAADLTYWESAARTIADVSKSDKIVVGKSTVPVKTAEAIEKILTHNSKGIKFQILSNPEFLAEGTAIGDLFQPDRVLIGGRETPEGQKAIQALKDVYAHWVPEDRILTTNLWSAELSKLAANAFLAQRISSVNAMSALCEATGADVAEVSYAVGKDSRIGPKFLNASVGFGGSCFQKDILNLVYICECNGLPEVAEYWKQVIKINDYQKSRFVNRVVSSMFNTVSQKKIAILGFAFKKDTGDTRETPAIDVCQGLLGDKALLSIYDPQVQKEHIQRDLIMKKFDWDHPLHLQPKSASSAVEQVTVTSDAYEATKEAHGVCILTEWDEFKTLDYKKIYDNMQKPAFVFDGRNVVNADKLREIGFIVYSIGKPLDAWLKDMPAIA

SEQ ID NO: 817 - protein, 480 aa, Arabidopsis thaliana
  misc_feature (1)..(480): Ceres CLONE ID no. 9930
  misc_feature (1)..(480): Functional Homolog of  Ceres CLONE ID no. 382867 at SEQ ID NO. 809 with e-value of 1.39E-213 and percent identity of 81.0
MVKICCIGAGYVGGPTMAVIALKCPDVEVAVVDISVPRINAWNSDTLPIYEPGLDDVVKQCRGKNLFFSTDVEKHVREADIVFVSVNTPTKTRGLGAGKAADLTYWESAARMIADVSVSDKIVVEKSTVPVKTAEAIEKILTHNSKGIKFQILSNPEFLAEGTAIKDLFNPDRVLIGGRETPEGFKAVQTLKDVYAHWVPEGQIITTNLWSAELSKLAANAFLAQRISSVNAMSALCEATGADVTQVSYAVGTDSRIGPKFLNSSVGFGGSCFQKDILNLVYICECNGLPEVAEYWKQVIKINDYQKSRFVNRVVSSMFNSVSNKKIAVLGFAFKKDTGDTRETPAIDVCKGLLEDKARLSIYDPQVTEDQIQRDLSMNKFDWDHPLHLQPMSPTTVKQVTVTWDAYEATKDAHGICIMTEWDEFKNLDFQKIFDNMQKPAFVFDGRNIMNLQKLREIGFIVYSIGKPLDDWLKDMPAVA

SEQ ID NO: 818 - protein, 483 aa, Dunaliella salina
  misc_feature (1)..(483): Public GI no. 61338425
  misc_feature (1)..(483): Functional Homolog of  Ceres CLONE ID no. 382867 at SEQ ID NO. 809 with e-value of 1.30E-173 and percent identity of 69.2
MATPPVKKIACIGAGYVGGPTMAVIALNSPDIEVVVVDINEERIKAWNSETLPIYEPGLDEVVKAARGRNLFFSTDTKKHVGEADIVFVSVNTPTKTTGIGAGKAADLTYWEGAARLIASVSTSSKIVVEKSTVPVKTAEAIGKVLKRNCSDPSVNFEILSNPEFLAEGTAIEDLQKPDRVLIGGVDTPSGQAAVAALKWVYNHWIPVERILTANLWSAELAKLTANAFLAQRISSINSISALCEASGANVQQVAHAIGTDTRIGNKFLSASVGFGGSCFQKDILNLCYVCETLGLREVADYWHAVVTMNDYQKQRFVERVIGSMFNTVSNKKIAIFGFAFKKDTGDTRETPAIDVCKGLVRDNAKVAVYDPKVTSEQIFRDMSTPKFEWDRPDYSRSHTRLLDNVQVCATPESAAEGAHAICVLTEWDCFKHYDYAAIYEKMTKPAFIFDGRNVLDHDKLREIGFITYALGKPLDPFLQKVY

SEQ ID NO: 819 - DNA, 1307 bp, Glycine max
  misc_feature (1)..(1307): Ceres CLONE ID no. 473126
  misc_feature (1)..(1307): Also Known As Ceres GEMINI ID no. 540E9
aagatttttcttgttcctttgttggtgggtttcctttccgcttcaggttcagcttcaacttcaaattctcagtgaaaccaattcagctgagtccaaatcccaaatccgaatcaaaatccgaagtgagatttgcgatggagaggcttcagcgaatgtttgcaggtgcaggtggagcgctagggcaccctcccccagattccccaactctcgattcctccgagcaggtctacatctcctcactcgctctcctcaagatgcttaagcacggaagggctggggttcccatggaggtgatgggtttgatgcttggagaattcgtggacgagtacaccgttcgtgtggttgatgtcttcgcaatgccgcagagtggcactggtgttagtgttgaggctgttgatcacgtttttcagactaatatgcttgacatgctcaaacaaactggaagaccagaaatggttgttggttggtaccattcccatcctggatttggctgttggctctctggtgttgacatcaatacacagcagagttttgaggctttgaatcagcgtgcagtggctgtggttgtagatccaatacaaagtgttaaaggcaaagtggtgattgatgcttttcgattgatcaatccgcagacaatgatgcttggtcaagaaccaaggcagacaacatccaatctgggacatctgaataaaccatccattcaagcattgatccatgggttgaaccggcattactattccatagccattaattacaggaagaatgaacttgaggagaagatgttgcttaatcttcacaagaagaaatggactgatggtttgacacttcggcattttgatacacattccaaaactaatgaacagactgtacaggaaatgctgaacttagctgtcaaatataacaaggctgttcaagaggaagatgagctgcctccagagaagcttgcaatagcaaatgtgggaagacaagatgcaaagaaacatctcgaagagcatatctcaaatttgatgtcttccaacatcgttcaaactctcggaatgatgcttgatactgttgtcttctagagtcattattttggaccttctggtttctgtagctgtgctaaggagacaatttgagttattacaatcactgtttccttattcttctcaaactatatttgaagacactagacatatattatttggacgggctgaaaaggtcaagaaagtaaatctcagcacatagtttgtgtggtgtctccctcagtattactggatatcttttaatgttatttctggattttctcttctacaaaattgtctatc

SEQ ID NO: 820 - protein, 309 aa, Glycine max
  misc_feature (1)..(309): Ceres CLONE ID no. 473126
  misc_feature (1)..(309): Also Known As Ceres GEMINI ID no. 540E9
  misc_feature (26)..(139): Pfam Name: Mov34 Pfam Description: Mov34/MPN/PAD-1 family
MERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRHFDTHSKTNEQTVQEMLNLAVKYNKAVQEEDELPPEKLAIANVGRQDAKKHLEEHISNLMSSNIVQTLGMMLDTVVF

SEQ ID NO: 821 - DNA, 1579 bp, Glycine max
  misc_feature (1)..(1579): Ceres CLONE ID no. 546496
  misc_feature (1)..(1579): Also Known As Ceres GEMINI ID no. 540H9
gacgcagcatcgtcactttcctcgctctcacaattttcccatcaaactcttgcttctcgcttcgattcagtttcttaactatcaattgagtgactatttgccctaattttggagcagcatagcttcagttagtcatgttgaattgatcgggtcggtgaggagatcgaaaaggttagttttattggatgaaatcaagaagaaaatctatgagataataattaagtagcatgatgatagaaagttcaagtaaagttcatggagccaataaccaacaagagggtgatgataacaacattaaaattgagaagctctcaaaggcaccctccacttcctcctcatcaagatcatggtcagcattcagaaatccaagaattgtgagagtgtcacgttccttgggaggaaaagataggcacagcaaggtttgcaccattaggggactgagggacagaaggattagactttctgttcccacagcaattgagttatatgatcttcaagaaaagcttggactcaatcaacctagcaaggtggtagattggttgcttgaaaccaccaaatctgatattgataagcttccaccacttcaatttcctcactgttttgctcatcatcaccaacaaaccctactgccaggtacctctcagttttctcttggaggcttctatgatgctgctgctaatgggggaaatgaaaaccacctcatggcaacaaagtcaactaggtattgggatatagattcacattcactaaataatggtaaggatctagttgaaagtgtgtcaaactccctaaaaggaaagagctggatcaaaacaaatgaacaagaaaatcatcaagatggaggaattggtggtagtagtagcactcataacaatagagaggaatattcttcagctcattataagctcttccctattgggacaactactaataactcttatttacctggtttgttaaacaatggcatgacacataactcatccaaccaccattctgagccttcaagtctatctttatcccactttggaagccatggattgtttccttcatcacataatgcccatccaagcagttgcagtggtgtgccattttcatcttgtaatttttctgcagcatcatctggtccccaattgcttttctgtccacctacttctgctacaccagcatctgctttttactcagtggaaagtgatccaagacaatccaacaacaatgttcagatctttagctcaagttcccaagtcatgatgcctcatcctctcatccaatctcttcattcaaccaattcaactcttaatcgacgcattccaacatcatttagttccaaacttcttgattcagataacaacaatgatcgtagccaaccaaataagggtagtagtactactcgttcttgaagctcctcatcgtggttccttcctgatgcaaacgatgtgaataactcttaatcctggacattcttttcatcaattattcaagaggctaaagcacatgatttaaattttctcactcagccgtgaatgtgagttttgtaggtatggcaatgctatacatatacaatatttatatttgaactttt

SEQ ID NO: 822 - protein, 389 aa, Glycine max
  misc_feature (1)..(389): Ceres CLONE ID no. 546496
  misc_feature (1)..(389): Also Known As Ceres GEMINI ID no. 540H9
  misc_feature (42)..(262): Pfam Name: TCP Pfam Description:
MMIESSSKVHGANNQQEGDDNNIKIEKLSKAPSTSSSSRSWSAFRNPRIVRVSRSLGGKDRHSKVCTIRGLRDRRIRLSVPTAIELYDLQEKLGLNQPSKVVDWLLETTKSDIDKLPPLQFPHCFAHHHQQTLLPGTSQFSLGGFYDAAANGGNENHLMATKSTRYWDIDSHSLNNGKDLVESVSNSLKGKSWIKTNEQENHQDGGIGGSSSTHNNREEYSSAHYKLFPIGTTTNNSYLPGLLNNGMTHNSSNHHSEPSSLSLSHFGSHGLFPSSHNAHPSSCSGVPFSSCNFSAASSGPQLLFCPPTSATPASAFYSVESDPRQSNNNVQIFSSSSQVMMPHPLIQSLHSTNSTLNRRIPTSFSSKLLDSDNNNDRSQPNKGSSTTRS

SEQ ID NO: 823 - DNA, 948 bp, Glycine max
  misc_feature (1)..(948): Ceres CLONE ID no. 560898
  misc_feature (1)..(948): Also Known As Ceres GEMINI ID no. 552H7
atactttccactttcactttcaaacatcacaaacactttttaacgttgtttgattttggtgcaatctttacttcacaacttcctcgtacttctgagaatcatcatcaaaaaccccaaactcatgatcatgatgatgatgaataggttccttccactctttgtgttcgcattgttattcatgtggtcggttcacgcagacaatgctcctgccccttcacccaagtcatcaccctcgtcgccgacggccaaaccaccctctccggcgacccatccggcgcctcctgcaaagtctccgactttatcaccgccttcacaatctccggcagtttctccatctgggtccaccccgccgccggcgactgcccctccggcgaagtctccggccactcagctaccatcttcggttcctccagcttccagcccttccaacaatgtctcttcgccaccggctccatccccagcgactcctccgccgacggttgctccggtgagttctccggtcggtactccgccggtggcagaggcgcctacgccagattctcctgccggaattccttcatcggccgtgccggcaggttcaccaatcacactaccatccagcagtgcctcgccgggaactgcgccggcgagttcgccggaaagttcacggggttcggttggtgatgaatcgggttcaagttccaaatgcagggctccgatgattttgggtggcgtggcactttgggtcgctttggctatgatctgaggcatcataggattatttttgagtatatttttttaatatttgccacattgatcgacgaataattgattgttattgatcaattttgtagttgggttggttcaattctattcattattttgtaattgattttctttaatgttagaagttagaacaaatttcattttgttaactgtttgtttcaatttgagaagggttttgcttcc

SEQ ID NO: 824 - protein, 207 aa, Glycine max
  misc_feature (1)..(207): Ceres CLONE ID no. 560898
  misc_feature (1)..(207): Also Known As Ceres GEMINI ID no. 552H7
MIMMMMNRFLPLFVFALLFMWSVHADNAPAPSPKSSPSSPTAKPPSPATHPAPPAKSPTLSPPSQSPAVSPSGSTPPPATAPPAKSPATQLPSSVPPASSPSNNVSSPPAPSPATPPPTVAPVSSPVGTPPVAEAPTPDSPAGIPSSAVPAGSPITLPSSSASPGTAPASSPESSRGSVGDESGSSSKCRAPMILGGVALWVALAMI

SEQ ID NO: 825 - DNA, 1164 bp, Glycine max
  misc_feature (1)..(1164): Ceres CLONE ID no. 566161
  misc_feature (1)..(1164): Also Known As Ceres GEMINI ID no. 552F3
gaagtcgaacaaaagacggctagaaacgcggcatggcgtcgtcgaagcttgtctcgacgaatccggatcttccacgggacccttcttcttcatcatcttcgtcttcttctatatctcccctttcttctcttctctccgatctgcaccccatggacgacctcctcaagtccatcacccccaattccgtcgacgacttctggaaggggatcgctgccgcctccaccgacaatgccggcggcgtgaccctcgaggatttcctcaccaaggccatccccgtcacagaggaagacgtcagaggtgctcctcctcctcctccttcttttctccccttccctgccgaaggctcttcctcctccgttgagcctttcgctaataatggcgttggcagcgcgccctcaaactcggttcagaaagggaagagaagggccgtggaggaaccggttgacaaggcaacgcttcagaagctgaggaggatgatcaagaatagagagtctgctgctaggtccagggagcgcaagcaggcttacacatctgagcttgagtatctggttcaccagctagagcaagagaatgcgcggttattaaaggaagagctctttgagtgcatcattccaattgaggtgatgcctaaaccgaagaaaaaacttcggagagtaaattcagcacaatcattgtgatctgtttgtcatcactcatggacagactaggctttgtggcttggtgtagatataagggggaaaggtttgagagattgcatgccattgcaggttctaggagttacattgtatagagaaagtaattgcagccaaataatccaagtaatttgattcaacctgaaagtattctattgatccactgcatgtggaagatccataagatccatggttctgggtgggttttgcccggattaggccttgcagggaaagtcgaaataagaatttgtgttaacttatgcaatttgaatgccatccttgcttgatttggtgggggatgaggtacagcaggcgagaggaatggatgaacaatgatcggtagattcgatataaactgttttagattaaaagatcacctatatgccacatgattcattgtgacaaattacttttttttagaagtaacatgacttgtgattttattattttaagcactcataatagttttagc

SEQ ID NO: 826 - protein, 214 aa, Glycine max
  misc_feature (1)..(214): Ceres CLONE ID no. 566161
  misc_feature (1)..(214): Also Known As Ceres GEMINI ID no. 552F3
  misc_feature (139)..(204): Pfam Name: bZIP_1 Pfam Description: bZIP transcription factor
MASSKLVSTNPDLPRDPSSSSSSSSSISPLSSLLSDLHPMDDLLKSITPNSVDDFWKGIAAASTDNAGGVTLEDFLTKAIPVTEEDVRGAPPPPPSFLPFPAEGSSSSVEPFANNGVGSAPSNSVQKGKRRAVEEPVDKATLQKLRRMIKNRESAARSRERKQAYTSELEYLVHQLEQENARLLKEELFECIIPIEVMPKPKKKLRRVNSAQSL

SEQ ID NO: 827 - DNA, 573 bp, Arabidopsis thaliana
  misc_feature (1)..(573): Ceres ANNOT ID no. 572593
  misc_feature (1)..(573): Also Known As Ceres GEMINI ID no. 5109D4
atgacgacggggctagtaacgccgggagatgtaatcgggaaagcgacagagtttaaagctggaaaaggagcttacgtcaacgacgccaccatctacgcttccctcacaggaacttgccggattgtttctcctcttcccgaatcaattgatcagagagctattgtggaagttacaggtcacaaggcacatggtcctattccagagactggttctgttgtcatagcaagagtgactaaagttatgactaagatggctgctgttgatatcttgtgtgttggttcaaaagccgttcgtgaaaattttgctggtgtaattaggcaacaagatgttagagcaacagagattgacaaagttgacatgcatcagtctttccatgctggtgacattgttagagctatgctgtctcttggtgatgcacgggcttactacttgtcaactgctaagaatgaacttggtgtggtctcagctgaaagtgctgcgggcgaaacaatggttccgataagttggacagagatgcagtgccccttgtcgggccaaaccgagcagagaaaagttgccaaggtgggtaattga

SEQ ID NO: 828 - protein, 190 aa, Arabidopsis thaliana
  misc_feature (1)..(190): Ceres ANNOT ID no. 572593
  misc_feature (1)..(190): Also Known As Ceres GEMINI ID no. 5109D4
MTTGLVTPGDVIGKATEFKAGKGAYVNDATIYASLTGTCRIVSPLPESIDQRAIVEVTGHKAHGPIPETGSVVIARVTKVMTKMAAVDILCVGSKAVRENFAGVIRQQDVRATEIDKVDMHQSFHAGDIVRAMLSLGDARAYYLSTAKNELGVVSAESAAGETMVPISWTEMQCPLSGQTEQRKVAKVGN

SEQ ID NO: 829 - DNA, 1627 bp, Glycine max
  misc_feature (1)..(1627): Ceres CLONE ID no. 601862
  misc_feature (1)..(1627): Also Known As Ceres GEMINI ID no. 552G10
attccatcatcattcaacaaagaaacacccaaaatggcatcctcagcctcgaccacgctgtcttctcccttcctgcgactagaattcccctcctcaaccaaacaacgctcttcaatctccatcagagcctcggtctccgagaaacccccgctaccggctgtgtcggtgacctccccggagcccagcaagcttccgatccgcaaaatccccggcgactgcgggttcccggtgatcggtcccttcaaggaccgccaagactatttctacaagcaagggcgcgacgagttcttcaagtcccgcatccaaaagtaccagtcaacggtcttccgcaccaacatgccccctggccccttcctcgcccccgacccaaacgtcgtcgttctcctcgatgccaaaagtttccccgtcctcttcgacaactctaaggtcgagaaaaaagacgtcttcactggaaccttcatgccttccaccgaactcaccggcggttaccgagtcctttcttacctcgacccctccgaacccaaacacgccctcctcaaacaactcatgttcttcctcctcaaatcacgtcgcgcccacgtcatctctgagttccacgcgtcctacaaagaactcttccacgccctcgaagccaacctcgccgaagccggcraagccagcttcggcgatgccaacgaccaagccgccttcaactttttatcacgctccctcttcaactccaaccccgscgataccaaactgggcctcgacggcccaaaaatcgttcagaaatgggttctctttcagatcggcccaattctccgattgggcctccctcaattcttagaagaatccaccatccgaaccttccgtctcccgttctctctgataaaaaaagattaccagagactatacgatttcttctacgagtcttccggtctagtattagacgaagcggagcgattggggatcacgcgcgatgaggcttgccataatctgttgttcgccacctgctttaactbcttcggcgggatgaagctttttttcccgaacgtgttgaagtggatcggacgcgccggggtgaagctccatgcgcggctggcggaggagattcgctccgccgtgagaagcggcggcggggagatcagcatggcggcgatggagaagatgccgctgatgaaatccgtggtgtacgaggcgttccgaatcgacccgccggtggcgctgcagttcgggagggcgaagagagacttgatcattgagagccacgaccacgcgtttcaggtgaaggaaggggagatgctgttcgggtaccaaccattcgcgacgaaggatcctaggatcttcgagagggccgaggagtttgtcggggacaggttcgtcggggaggaaggggagaagctcctcaagcacgtgctgtggtccaatgggcctgagactgagtctccaacacttgggaacaagcaatgcgccggaaaagacttcgtcaccttggtttckaggmtwttmvywgyggmgttctttcttcgctatgattccttcgagattcaagtgggaacttctyccttgggttcttscgwwactattacttccctaaagagagcaagcttttagttagttagttaattaattaattaattawtwtttg

SEQ ID NO: 830 - protein, 519 aa, Glycine max
  misc_feature (1)..(519): Ceres CLONE ID no. 601862
  misc_feature (1)..(519): Also Known As Ceres GEMINI ID no. 552G10
  misc_feature (347)..(402): Pfam Name: p450 Pfam Description: Cytochrome P450
  misc_feature (207)..(207): Xaa is any aa, unknown, or other
  misc_feature (232)..(232): Xaa is any aa, unknown, or other
  misc_feature (323)..(323): Xaa is any aa, unknown, or other
  misc_feature (482)..(482): Xaa is any aa, unknown, or other
  misc_feature (484)..(484): Xaa is any aa, unknown, or other
  misc_feature (485)..(485): Xaa is any aa, unknown, or other
  misc_feature (486)..(486): Xaa is any aa, unknown, or other
  misc_feature (487)..(487): Xaa is any aa, unknown, or other
  misc_feature (488)..(488): Xaa is any aa, unknown, or other
  misc_feature (504)..(504): Xaa is any aa, unknown, or other
  misc_feature (508)..(508): Xaa is any aa, unknown, or other
  misc_feature (509)..(509): Xaa is any aa, unknown, or other
MASSASTTLSSPFLRLEFPSSTKQRSSISIRASVSEKPPLPAVSVTSPEPSKLPIRKIPGDCGFPVIGPFKDRQDYFYKQGRDEFFKSRIQKYQSTVFRTNMPPGPFLAPDPNVVVLLDAKSFPVLFDNSKVEKKDVFTGTFMPSTELTGGYRVLSYLDPSEPKHALLKQLMFFLLKSRRAHVISEFHASYKELFHALEANLAEAGXASFGDANDQAAFNFLSRSLFNSNPXDTKLGLDGPKIVQKWVLFQIGPILRLGLPQFLEESTIRTFRLPFSLIKKDYQRLYDFFYESSGLVLDEAERLGITRDEACHNLLFATCFNXFGGMKLFFPNVLKWIGRAGVKLHARLAEEIRSAVRSGGGEISMAAMEKMPLMKSVVYEAFRIDPPVALQFGRAKRDLIIESHDHAFQVKEGEMLFGYQPFATKDPRIFERAEEFVGDRFVGEEGEKLLKHVLWSNGPETESPTLGNKQCAGKDFVTLVXRXXXXXFFLRYDSFEIQVGTSXLGSXXTITSLKRASF

SEQ ID NO: 831 - DNA, 789 bp, Arabidopsis thaliana
  misc_feature (1)..(789): Ceres ANNOT ID no. 841947
  misc_feature (1)..(789): Also Known As Ceres GEMINI ID no. 5110C1
atgtggttgaagattcgtgggattccgattcagtatctttgtgatgggacggttcgtgagattgcttcgtctatgggtgaggtaatggaagttgaattagatgatggaatggttgatttgagttctgtgcgtgctcgtgtgaatgtttgtgtggatacacgtttgtgttttaagaaagtggcgaggtttgattctggagaggttaagattgtgagttttaggtatgaggatattggtatgagtaaagcgaggtttaagttttgttttaattgtggggatatgaatcatttggctaggaattgtttgatcccttgggttgatgttcctgatccttatgaacgttctctttcaccaccgcctcatgagtctaactctgatggttctgctgagggcaactgtggtgatggtggaacttcttctggtactttggagctgctcgaattggtggatgcggttcaggactttcctgttggggatggtgagcagctcgaattggcgggtgtggttcaggacttgcctgttggggatggtgagcagcagcagcaaggtcttgatggtgttgaggaagctaatgctacgcaggtggattctgaaatggttggaatttcatctgaggggtctaaaaggaagtttgatgcggtggagcagggtgatgaaaatccggaaaagcggcttagaggaatcactgatgcaactgagggaggaagcactgacgcaactcagggaggaagcactgatgcaactgaggagggtttaggggttagccttaagccacttcaaggagaatga

SEQ ID NO: 832 - protein, 262 aa, Arabidopsis thaliana
  misc_feature (1)..(262): Ceres ANNOT ID no. 841947
  misc_feature (1)..(262): Also Known As Ceres GEMINI ID no. 5110C1
  misc_feature (86)..(103): Pfam Name: zf-CCHC Pfam Description:
MWLKIRGIPIQYLCDGTVREIASSMGEVMEVELDDGMVDLSSVRARVNVCVDTRLCFKKVARFDSGEVKIVSFRYEDIGMSKARFKFCFNCGDMNHLARNCLIPWVDVPDPYERSLSPPPHESNSDGSAEGNCGDGGTSSGTLELLELVDAVQDFPVGDGEQLELAGVVQDLPVGDGEQQQQGLDGVEEANATQVDSEMVGISSEGSKRKFDAVEQGDENPEKRLRGITDATEGGSTDATQGGSTDATEEGLGVSLKPLQGE

SEQ ID NO: 833 - DNA, 744 bp, Brassica napus
  misc_feature (1)..(744): Ceres CLONE ID no. 982774
  misc_feature (1)..(744): Also Known As Ceres GEMINI ID no. 552H1
acaagttctaaacaatggtgtcgtcgaagaaaccgaaccaggagaagaagccgaggagcgatggcgtcaacaaagctggtggtggtaacacacgcagctccggttccaaaccgaagaagaagaataccaacgtacaggccaatgcgaagaaggagccggaggttcacgagatctcggagtcttcgagcagcgactccgcaggagaagcgagacgtgatgagccggtgaaaagcaatggcggaggagtggaagacgctaagatgattaggtttccgatgaataggatccggaggataatgagaagcgataactctgctcctcagatcatgcaggacgccgtgtttcttgtcaacaaggccacggaattgttcattgagcggttttctgaagaagcttatgaaagttctgtccaggacaaaaagaaattcatccactacaaacatctctcatctgtagttagcaacgacgagagatacgagttccttgcggattgtgttcgtgagaaactaaaagcagacgtggcgatggaggaatgggaaagaagcatgacagatgcaggctgataaatacaccggttggaagcaacctgaaccgcgtgtcctgtcctggtttattgattccatctgcctggtcttcaccttttttaataacctccataatgagattgcacatatttcattactaaaatgtatcaattgcaataatttttatagtataatctgccaacgatgaactttacgaatc

SEQ ID NO: 834 - protein, 182 aa, Brassica napus
  misc_feature (1)..(182): Ceres CLONE ID no. 982774
  misc_feature (1)..(182): Also Known As Ceres GEMINI ID no. 552H1
  misc_feature (84)..(148): Pfam Name: CBFD_NFYB_HMF Pfam Description: Histone-like transcription factor ( CBF/NF-Y) and archaeal histone
MVSSKKPNQEKKPRSDGVNKAGGGNTRSSGSKPKKKNTNVQANAKKEPEVHEISESSSSDSAGEARRDEPVKSNGGGVEDAKMIRFPMNRIRRIMRSDNSAPQIMQDAVFLVNKATELFIERFSEEAYESSVQDKKKFIHYKHLSSVVSNDERYEFLADCVREKLKADVAMEEWERSMTDAG

SEQ ID NO: 835 - DNA, 2363 bp, Arabidopsis thaliana
  misc_feature (1)..(2363): Ceres CDNA ID no. 12575172
  misc_feature (1)..(2363): Also Known As Ceres GEMINI ID no. 5110F6
gactgagaaaaaacaagttttctctctctaggcactcacattcattctttgcttcaaccttttaattcacgagatccccaatctctctttcgatgccttttcacagagtatctaatcctcctcctcctccattcatcttctccttctccattcttctccgtcgtctccattaacaaacaaccatttctctcaccggaactccattttagggttttcttcgattctctcaaatttcattcctttcactccccacaacactcaaaatgcccaagtcagttaaacccatctctgaatctgacaaactctccgatcatctccgtgattcatcactaacctccgagatcaacaaacctgatttccgtgagctagatcttggttcaccggtttctccgcttcgttctcagccacgtggactcaccaccaccactactactacaaccactagtagcagtagttctagctcttccggatctgtaacgggtcggattaaacatgctccggttatcggaagatctaattctgttcgtagtcaatctaattcgtctagtgggaataataatctaagaccgagatcggactctgctacaacttcttcttcttctcattcacaaccacttctctcctcctcctcctcctctgctacttctccagctccgacgtctccggcgaatgtacttcccaccggaaacatttgtccttctgggaagatccaaatcactggaatgactcaaagccgttcaagaagcgatgttcttggatctggtactggaacttatggacatggaagtataatgcgaggaggtggtatatctccggccaaacctaccaacaccggaggaggatccaactcgccggtaaatgtcggtagctctagtagaagtagtagtactgttgctacgggagagactcctatatggaaaaaagcgattttaggttcggattcagaggaagtgaagagagtagggaatgaaatgtataggaaaggtttgtttaatgaggctttgaagttgtatgatagagcaatagctttatctccgactaacgctgcttaccggagtaatcgagctgccgcattgattggtttgtctcgaattggtgaagctgttaaggaatgtgaagatgctgttagatcggatcctaactatggaagagctcatcaccgtttggccttattgcttattagattaggtcaggttaatagtgcaaggaagcatctttgttttcttgggagaccatcagatcccatggagttgcagaagcttgaagcagtggagaaacatttgattaaatgtgttgatgcgcgaagagtcactgattggaaaacagttttgatagaagcagatgctgctattgtttctggagctgatttttctccacagctatttatgtgtaaagtagaagcattcttgaaacttcaccggcttgatgatgcacagtcaaagctattagaagttcctaaagtagagccgttccctgtatcttgttcgcagactcggttttctggtatggcttgtgaagcttatatatattttgtcaaagctcaaatcgagatggctttaggaaggtttgaaaatgcagttatggctgctgagaaagctagccaaatcgatccaagatgcaacgaagttgctatgttacataatactgttacattggttgctagggctcgtgctcgtggcaatgatctttataaatcagaaagatacactgaagcaagttcagcttatgctgaaggccttaggcttgatccttgcaacgctattctatattgtaatcgagcagcttgttggtttaaacttggaatgtgggaacgctcgattgaagattgtaaccaagcgctgcgttatcaaccaagttacacaaagccacttcttcggagggctgcctcaaatagcaagatggaaagatggggagctgcagtgagtgattatgaggccttgataagagaacttcctcatgacaaggaagttgctgaatctttattccatgctcaagttgcattgaagaaatctcgtggagaagaagttttaaatatggaatttggtggcgaagtagaggaaatttatagtcttgaacagtttaaatctgccatgaatttaccaggagtttcggttatccatttctcgacagcctctgatcatcaatgcaagcaaatatctccattcgtggactcgctatgtactcgttacccatctatacacttcctcaaggtggatatcgataaatgtccttcaataggtaatgcagagaatgtgagggttgtaccgacagtgaagatatacaagaacggtagtcgggttaaggagattgtctgtccaagcaaagaagtgttggagtactcggtgagacactatagcggttaa

SEQ ID NO: 836 - protein, 699 aa, Arabidopsis thaliana
  misc_feature (1)..(699): Ceres CDNA ID no. 12575172
  misc_feature (1)..(699): Also Known As Ceres GEMINI ID no. 5110F6
  misc_feature (227)..(260): Pfam Name: TPR_1 Pfam Description:
  misc_feature (419)..(452): Pfam Name: TPR_2 Pfam Description:
  misc_feature (628)..(699): Pfam Name: Thioredoxin Pfam Description:
MPKSVKPISESDKLSDHLRDSSLTSEINKPDFRELDLGSPVSPLRSQPRGLTTTTTTTTTSSSSSSSSGSVTGRIKHAPVIGRSNSVRSQSNSSSGNNNLRPRSDSATTSSSSHSQPLLSSSSSSATSPAPTSPANVLPTGNICPSGKIQITGMTQSRSRSDVLGSGTGTYGHGSIMRGGGISPAKPTNTGGGSNSPVNVGSSSRSSSTVATGETPIWKKAILGSDSEEVKRVGNEMYRKGLFNEALKLYDRAIALSPTNAAYRSNRAAALIGLSRIGEAVKECEDAVRSDPNYGRAHHRLALLLIRLGQVNSARKHLCFLGRPSDPMELQKLEAVEKHLIKCVDARRVTDWKTVLIEADAAIVSGADFSPQLFMCKVEAFLKLHRLDDAQSKLLEVPKVEPFPVSCSQTRFSGMACEAYIYFVKAQIEMALGRFENAVMAAEKASQIDPRCNEVAMLHNTVTLVARARARGNDLYKSERYTEASSAYAEGLRLDPCNAILYCNRAACWFKLGMWERSIEDCNQALRYQPSYTKPLLRRAASNSKMERWGAAVSDYEALIRELPHDKEVAESLFHAQVALKKSRGEEVLNMEFGGEVEEIYSLEQFKSAMNLPGVSVIHFSTASDHQCKQISPFVDSLCTRYPSIHFLKVDIDKCPSIGNAENVRVVPTVKIYKNGSRVKEIVCPSKEVLEYSVRHYSG

SEQ ID NO: 837 - DNA, 2094 bp, Populus balsamifera subsp. trichocarpa
  misc_feature (1)..(2094): Ceres GDNA ANNOT ID no. 1519981
  misc_feature (1)..(2094): Functional Homolog of  Ceres CDNA ID no. 12575172 at SEQ ID NO. 836 with e-value of 4.99E-218 and percent identity of 68.6
atgtcgcattcaccgaaaccctccattggaggaggaaacttagacctcaattcactaactgatcaactccgtgactcactgtcttcattcgaagccaacaagcctgatttccgtgaactcgatctgggttcaccagtttcacctctccgaactcgtggtggactcatcactacaaccaccgccaccgccaccgccgccaccaccaccaccaccaccacctcctccagctccagttcctccggatccgcatccggtgctcaaaacccacttcacaaacccaacaatagcaaccactcaggcgagttatcaaactcgagtgagagcagccccactgctggtgccaaaaagggtcaaccgggtcattctagatccgactctttaacttattcgggtcaaattaccagccagagtgctgtaaactctcctgcaacaggcaatgtgttacctaccggtaacatttgtccgtcgggcaggatcttgaagacaggcatgggaatggcgaatcggagtgccaaagcggatgttttaggatccgggaccgcaaattatggtcacgggagcataatgcggggcggagggagcgcaaaatgtgctaacttggatgttgttaattcggcaagtaggaatgcttggagtgtgcgtgcagggagtgtggatccggaggaggtgaagaggactggaaatgagatgtataaaaaagggtgttttggggaggcgttaggattgtatgacaaggctattgctttggcacctgggaatgctgcttataggagtaacagggcggcagcgttgatgggattagggagagttgtggaggcggtgaaagagtgcgaggaggctgttaggttggatcctaattattggagagcacatcagaggttgggggttttgttaattaggttaggactggttgagagtgcccggaagcacctatgcttccctggacagcatccagatcctgtcgaattgcagaagttgcaattagtagagaaacatcttagcaaatgttctgatgcacggaaggttaatgattggaatggtacgttaagggaagcagaagcttcaattgctgctggagcagactattgcccccagctctttatgtgtagagctgaagcacttttgaagctccaccaattagaagatgctgaatcatgcttattgaaagttccaaaattagaaccacatgccacctgctcgcaggctagattttttgggatgctttctgaagcttacccgttcttggtccaagcacagatcgagatggctctaggaaggtttgagaatgcagttgcagctgctgagaaagctggacagattgattcacgaaatgttgaagtagcagtgctgcttaaaaatgtgcgactagtagctagagctcgtacccgcggcaatgatctcttcaaatcggaaaggttcactgaagcctgttcagcatatggggaaggccttaggcttgatccttcaaactctgttctctattgcaacagggcagcatgttggtttaagcttggatcatgggagagatccattgatgactgcaatcaagctttacgaatccaacctaactacacaaaagcccttcttagaagagctgcctcaaacagcaagttagaaaggtgggctgatgccgtgagagattatgaagttttgagaagggaacttccagatgacaatggagtagctgaatctctatttcatgctcaagttgcattgaagaaatctcgtggagaagaagtgtataatatgaagtttggcggtgaagtagaggaagtgttggggtttgaacagttcagagctgcaatatcattgcctggcaagtcttccctttcatgtgtttcagtggttcatttcaaatcatcctctaatgtgcactgcaagcagatatctccatttgtggatacattatgtggtcggtatccatccataaactttctcaaggtggacgtggaggaacatccagcaattgcaaatgccgaggatgtgaggattgttccaacattcaagatatacaaaaatggcaaccgagtgaaggagattgtctgcccaagtcatgatgtgctggaacattcggtgaggcattacagcttttag

SEQ ID NO: 838 - protein, 697 aa, Populus balsamifera subsp. trichocarpa
  misc_feature (1)..(697): Ceres GDNA ANNOT ID no. 1519981
  misc_feature (1)..(697): Functional Homolog of  Ceres CDNA ID no. 12575172 at SEQ ID NO. 836 with e-value of 4.99E-218 and percent identity of 68.6
MSHSPKPSIGGGNLDLNSLTDQLRDSLSSFEANKPDFRELDLGSPVSPLRTRGGLITTTTATATAATTTTTTTSSSSSSSGSASGAQNPLHKPNNSNHSGELSNSSESSPTAGAKKGQPGHSRSDSLTYSGQITSQSAVNSPATGNVLPTGNICPSGRILKTGMGMANRSAKADVLGSGTANYGHGSIMRGGGSAKCANLDVVNSASRNAWSVRAGSVDPEEVKRTGNEMYKKGCFGEALGLYDKAIALAPGNAAYRSNRAAALMGLGRVVEAVKECEEAVRLDPNYWRAHQRLGVLLIRLGLVESARKHLCFPGQHPDPVELQKLQLVEKHLSKCSDARKVNDWNGTLREAEASIAAGADYCPQLFMCRAEALLKLHQLEDAESCLLKVPKLEPHATCSQARFFGMLSEAYPFLVQAQIEMALGRFENAVAAAEKAGQIDSRNVEVAVLLKNVRLVARARTRGNDLFKSERFTEACSAYGEGLRLDPSNSVLYCNRAACWFKLGSWERSIDDCNQALRIQPNYTKALLRRAASNSKLERWADAVRDYEVLRRELPDDNGVAESLFHAQVALKKSRGEEVYNMKFGGEVEEVLGFEQFRAAISLPGKSSLSCVSVVHFKSSSNVHCKQISPFVDTLCGRYPSINFLKVDVEEHPAIANAEDVRIVPTFKIYKNGNRVKEIVCPSHDVLEHSVRHYSF

SEQ ID NO: 839 - DNA, 1126 bp, Arabidopsis thaliana
  misc_feature (1)..(1126): Ceres CDNA ID no. 12605556
  misc_feature (1)..(1126): Also Known As Ceres GEMINI ID no. 5109B6
gaaaagggaagaagcaaagtgaagaagctccagaacacgccatagctatggctcttctctgtccttctcttccctctccgaattctcgtcttttcaggtgcaggagcagcaatatttcgagcaagtatcatggagcctcaaaggagctgatgattgctcgttctggtgtgtctacgagatcaatttcttcggaaaaggggctttctcgtagggatttagtgctcattggtctctcttctccgttgtctatgttcttgccattgtcttctccagtcactcatgcagaagaagacgtgaaaatgagtggagaagaattgaaaatgggtacaatggtggatgatattaatgcttattcttatgcttacccattggattatccatctgagaagcttgtcttcaaatgggttgaatcaagaaagcctgaaagatactcttcagctgcaccactctctcctgatgcacgtttacggattgtttctgaacgagttgacctaactgacaacctcgtcatttctatttcgataggtcccccaaactcaagattaacatcaaaagaaaagaaaacatggtccgctaaagaagttgctgattctgttttgtctgataaatcagcattgcgtgtcacctcaagtcagcgtcttgaagagagttcggttcttgatgctcatgctagtgatattgatggggagccttactggtactacgagtaccttgtccgcaaatcaccaaccaaaattgctgaagcatcaaagctttacagacactatatttcttcaacagctgaacgtgatggatacttatacaccataaatgcttcaacccttggcaagcagtgggacaagatgggaccggtgttagaaagagcagtaggatcctttaggcttcttcctcctactgatagttatgttcctccatacaaggatccatggaggttttggtgatgcttccatctgcctcatgaaatttcttttttcgaaattgtcgttaattttgataggagaggaggttatgaaagttgtagtgtgagaaatgagccaagcgaagtgatttttccaaatccgaatatcttgttcactatcagatgtattgagattgagatataactagcattttcttttaaactcat

SEQ ID NO: 840 - protein, 297 aa, Arabidopsis thaliana
  misc_feature (1)..(297): Ceres CDNA ID no. 12605556
  misc_feature (1)..(297): Also Known As Ceres GEMINI ID no. 5109B6
  misc_feature (201)..(280): Pfam Name: PsbP Pfam Description:
MALLCPSLPSPNSRLFRCRSSNISSKYHGASKELMIARSGVSTRSISSEKGLSRRDLVLIGLSSPLSMFLPLSSPVTHAEEDVKMSGEELKMGTMVDDINAYSYAYPLDYPSEKLVFKWVESRKPERYSSAAPLSPDARLRIVSERVDLTDNLVISISIGPPNSRLTSKEKKTWSAKEVADSVLSDKSALRVTSSQRLEESSVLDAHASDIDGEPYWYYEYLVRKSPTKIAEASKLYRHYISSTAERDGYLYTINASTLGKQWDKMGPVLERAVGSFRLLPPTDSYVPPYKDPWRFW

SEQ ID NO: 841 - DNA, 888 bp, Populus balsamifera subsp. trichocarpa
  misc_feature (1)..(888): Ceres GDNA ANNOT ID no. 1455463
  misc_feature (1)..(888): Functional Homolog of  Ceres CDNA ID no. 12605556 at SEQ ID NO. 840 with e-value of 3.00E-94 and percent identity of 67.3
atggcaatggctcttctttgttctccttcacacttcacaacccatcaccacaatcctttctttaggaaccaaagtagaatcttgttaagccagaagaaatgtaaattaaaagagaagattatggcatgttcatgtgcttgttcttcttcagatcccagcttacaaaatgggttttgtagaagggacttggtgctttttggtctctcttcttcattatccattgccttcccatcttcagagatacttgctgaggaagatctgaaaatggcttcagtggttgatgaaataaacgcctatacttattcatatccagcggaattgccatcaaagaagttcctcttcaaatgggtggaatccagaaaacctgaacgctactcatcagctgcaccactgtcctctgatgcacgcctgcgcattgtgtccgagcgcgttgacatcattgataacctcatcctctctgtttcgataggtcctccaaatcttcagtttgtaaaatctaaagacaagaatacctgggctgcaaaagatgttgctgattctgttttgtctgacaagtcttcactgcgagtcacttcaactcaacgtttgtctgagagttcaattcttgatgcgcatgctaatgaaattgatggtgagccgtactggttttatgaatatattgtacgcaagtcacccaccaaaaatgctcaagaatcaaatcttttccgacgctacattgcttcaacagctgaacgagatgggtatttgtactctctaagtgcttcaactctaagcaagcagtgggacaagatggggccttacttggaaaaaactgtggcctcgttccgccttctccctcccacaggggactatgtacctccatacaaggatccatggagattttggtga

SEQ ID NO: 842 - protein, 293 aa, Populus balsamifera subsp. trichocarpa
  misc_feature (1)..(293): Ceres GDNA ANNOT ID no. 1455463
  misc_feature (1)..(293): Functional Homolog of  Ceres CDNA ID no. 12605556 at SEQ ID NO. 840 with e-value of 3.00E-94 and percent identity of 67.3
MALLCSPSHFTTHHHNPFFRNQSRILLSQKKCKLKEKIMACSCACSSSDPSLQNGFCRRDLVLFGLSSSLSIAFPSSEILAEEDLKMASVVDEINAYTYSYPAELPSKKFLFKWVESRKPERYSSAAPLSSDARLRIVSERVDIIDNLILSVSIGPPNLQFVKSKDKNTWAAKDVADSVLSDKSSLRVTSTQRLSESSILDAHANEIDGEPYWFYEYIVRKSPTKNAQESNLFRRYIASTAERDGYLYSLSASTLSKQWDKMGPYLEKTVASFRLLPPTGDYVPPYKDPWRFW

SEQ ID NO: 843 - protein, 314 aa, Oryza sativa subsp. japonica
  misc_feature (1)..(314): Public GI no. 54290426
  misc_feature (1)..(314): Functional Homolog of  Ceres CDNA ID no. 12605556 at SEQ ID NO. 840 with e-value of 2.39E-83 and percent identity of 62.1
MAAAALLSPPPSPSPSPTPSSLHPRQALRFAVGTGGGGRARATSTGTRRRAALVPCSSSVSARGPASGGDGLALERRRLLLSGLVSSFVLVLPVSDSHAVAEMDEDVKMATLVDPINAYSFLYPVELPGKKFTFKWVESRKPERYSSAAPLSPDARQRIVSERVDMIHNVVISVSIGPPNSRFPPSKDKSKWDPKDVADWILAEKSSLVTTGQRMTESSVLDAHSSDVDGEPYWYYEYLVRKSPTQSAPEPNLFRHNVACTAERDGYLYSLNASTLSKQWESMGPSLQKTVASFHLLPPTENYVPPYQDPWRFW

SEQ ID NO: 844 - protein, 303 aa, Zea mays
  misc_feature (1)..(303): Ceres CLONE ID no. 372747
  misc_feature (1)..(303): Functional Homolog of  Ceres CDNA ID no. 12605556 at SEQ ID NO. 840 with e-value of 1.30E-86 and percent identity of 61.2
MAGALLSSPHTLPSPTSQSPFRPRSRGPLHAGAARVLPLRRRAFVLASCSREPAARNRGLEVERRRLLMSGLVSSFAIMLPISEAYAVMETDEDVKMNTQIDEINAYSFLYPVELPGKKFAFKWVESRKPERYSSAAPLSPDARQRIVSERVDMIHNVVISVSIGPPNSRFLPSKDKSSWDPKDVADCILSDRSTMKVTTGQRMTESSVLDAHVAEVDGEPYWYYEYLVRKSPTKSAPEPNLFRHNVACTAERDGYLYSLNASTLSKQWESMGPFLQKTVASFRLLPGTENYVPPYKDPWRFW

SEQ ID NO: 845 - protein, 295 aa, Glycine max
  misc_feature (1)..(295): Ceres CLONE ID no. 553394
  misc_feature (1)..(295): Functional Homolog of  Ceres CDNA ID no. 12605556 at SEQ ID NO. 840 with e-value of 3.39E-86 and percent identity of 61.0
MVFPSSSLSLFFPIPTLLPNNLIFRNNTRAILNQHKCPFSEERPRFSCCALKPTSQNRIFRRDLMLLGLTSLSPTMPLSVTLAEEEPKMASFLDEINAYSYMYPVELPSDNFTFKWIESRKPERYSSAAPLSPDARLRIVSERLDFIDNVIISVTIGPPNSSYIKSKDKSKWTAKDVADSVLADRSSLRVTSSQRLEESSVLNTHSSEIDGEMYWYYEYLVRKAPLRLTDESSTYRHYLASTAERDGYLYSISASTVSPLWEKLGPFLDKAVNSFRLLSPTENYVPPYKDPWRFW

SEQ ID NO: 846 - protein, 360 aa, Oryza sativa subsp. japonica
  misc_feature (1)..(360): Public GI no. 34912704
  misc_feature (1)..(360): Functional Homolog of  Ceres CDNA ID no. 12605556 at SEQ ID NO. 840 with e-value of 1.29E-66 and percent identity of 59.5
MAAAALLSPPPSPSPSPTPSSLHPRQALRFAVGTGGGGRARATSTGTRRRAALVPCSSSVSARGPASGGDGLALERRRLLLSGLVSSFVLVLPVSVCTLYVLVSTLLMSHDDSVDSHAVAEMDEDVKMATLVDPINAYSFLYPVELPGKKFTFKWVESRKPERYSSAAPLSPDARQRIVSERVDMIHNVVISVSIGPPNSRFPPSKDKSKWDPKDVADWILAEKSSLKVTTGQRMTESSVLDAHSSDVDGEPYWYYEYLVRKSPTQSAPEPNLFRHNVACTAERDGYLYSLNASTLSKQWESKIMFLHTRIHGDFGDIAIRFLLLLFHVLGDLGTSGFRTYFPVMDASVMSALSVLQNEA

SEQ ID NO: 847 - protein, 301 aa, Triticum aestivum
  misc_feature (1)..(301): Ceres CLONE ID no. 678505
  misc_feature (1)..(301): Functional Homolog of  Ceres CDNA ID no. 12605556 at SEQ ID NO. 840 with e-value of 4.39E-84 and percent identity of 57.2
MAAALLSPASPLPRSSSAAHPRSKGAAGAAAGCAPPSRRRAVSCSCAPDSWSLGLERRQLVLSGLVSSFAIALPITVVQSCAAATEVELDDGVKMAMLVDETNAYSFLYPVQLPGKKTSFRWVESRKSERYSSAAPLSPDARQRIVSERLDMINNAVISVSIGPPSSRFLPSKDKTTWAAKNVADCVLSDKSSLKVTTTQRMAESSVLDAHTADVDGEPYWYYEYIVRKSPTKSAPEPNLFRHNVACTAERDGFLYSLNASTLSKQWESMGPLLQKAVASFHLLPPTEKYVPPYQDPWRFW

SEQ ID NO: 848 - DNA, 735 bp, Arabidopsis thaliana
  misc_feature (1)..(735): Ceres CDNA ID no. 12724333
  misc_feature (1)..(735): Also Known As Ceres GEMINI ID no. 5109D10
atggaggagctggattttagttcaaaaacaacaacttctcgtctaaagctatttggatttagtgttgatggagaagaagatttctccgatcaatcagtcaaaactaacctatcttctgtatcaccggaacgtggcgagtttccggcaggatcttccggaagaagtggcggtggtgtacgaagccgaggcggaggaggaggaggaggagaacgtaagtatgagtgtcagtattgttgtagagagtttggtaactcacaagccttaggtggtcaccaaaacgctcacaagaaagagcgtcaacagcttaaacgtgctcagcttcaagctacacgaaacgcagccgcaaatttctcaaacgctggatcagcgtctcagtttttaaggaatcctatagtctctgcttttgctcctccgcctcatcttttatcatcatccgccgtgcctcagcctatgggaggtccttggatgtatcttccacgtgtttctccatctcaacttcacgtgtctcatggctgcgtcatccaagatggttcgggtggtgcgggtgctggtgggttctcgtacgagtatggggctcgtgattcagggtttggagtagttggggctcagatgagacatgttcaggcccatgggccgagaccatcggttaatgggttttcaagagaagtaggaactacttttgatgatggtttagggttggatttgcatctcagtcttgcacctgctggtcattga

SEQ ID NO: 849 - protein, 244 aa, Arabidopsis thaliana
  misc_feature (1)..(244): Ceres CDNA ID no. 12724333
  misc_feature (1)..(244): Also Known As Ceres GEMINI ID no. 5109D10
MEELDFSSKTTTSRLKLFGFSVDGEEDFSDQSVKTNLSSVSPERGEFPAGSSGRSGGGVRSRGGGGGGGERKYECQYCCREFGNSQALGGHQNAHKKERQQLKRAQLQATRNAAANFSNAGSASQFLRNPIVSAFAPPPHLLSSSAVPQPMGGPWMYLPRVSPSQLHVSHGCVIQDGSGGAGAGGFSYEYGARDSGFGVVGAQMRHVQAHGPRPSVNGFSREVGTTFDDGLGLDLHLSLAPAGH

SEQ ID NO: 850 - protein, 236 aa, Brassica napus
  misc_feature (1)..(236): Ceres CLONE ID no. 963612
  misc_feature (1)..(236): Functional Homolog of  Ceres CDNA ID no. 12724333 at SEQ ID NO. 849 with e-value of 2.89E-96 and percent identity of 80.5
  misc_feature (162)..(162): Xaa is any aa, unknown, or other
  misc_feature (173)..(173): Xaa is any aa, unknown, or other
  misc_feature (183)..(183): Xaa is any aa, unknown, or other
  misc_feature (184)..(184): Xaa is any aa, unknown, or other
  misc_feature (187)..(187): Xaa is any aa, unknown, or other
  misc_feature (194)..(194): Xaa is any aa, unknown, or other
  misc_feature (196)..(196): Xaa is any aa, unknown, or other
  misc_feature (203)..(203): Xaa is any aa, unknown, or other
  misc_feature (213)..(213): Xaa is any aa, unknown, or other
  misc_feature (218)..(218): Xaa is any aa, unknown, or other
  misc_feature (231)..(231): Xaa is any aa, unknown, or other
MEELNFRSKTSTSRLRLFGFSVDGEEDFFEQTVKPNQSSDSPEHNEFPAGSSGRSGGGVRSRGGGGGERKYECQYCCREFGNSQALGGHQNAHKKERQQLKRAQLQATRNAAAKYSNVGSASPLLRNPMVSAFAPRPHHLSSTVSPPGGGGSWMYLPRVSPXQLHVSHGCVVXDGAGAGTNGXXYEXGFGFNGXQXRHVQAHXPRPLVNGFSXEVGSXFDDGLGLDLHLSXAPAGH

SEQ ID NO: 851 - DNA, 744 bp, Populus balsamifera subsp. trichocarpa
  misc_feature (1)..(744): Ceres GDNA ANNOT ID no. 1463957
  misc_feature (1)..(744): Functional Homolog of  Ceres CDNA ID no. 12724333 at SEQ ID NO. 849 with e-value of 5.79E-50 and percent identity of 57.5
atggcagagctagactacgaaacaaaacataactcaacctctacacgcttaaaactattcggcttcaacgtctcagaagatgaagaacaaataaccacaacagactctctcaagtcatcttcttgtaattctcctgacgactcctcttttgctacagctacaacgacagtcccagctacggcttcaggagacagcagaaaatacgagtgtcagtactgctgtagggaattcgcaaactcacaagcccttggtggccatcaaaacgcacacaaaaaagaaagacagcaactcaaacgagctcaaatgcaagccacaagaaacgcagctgcggctgccgtttcttttggtagaaaccctatgatctctgcctttgctcctcctccccatctcctggcccaagcagcaggccaggttatggtcccggcggcttctccgtcgtgggtttacttgccacgtgctgcaacaccgtttcacgtttcacatgggtgtgtgttccctagtggggtgagtgggaggggtggagggggcttaccatatggtgacagtgtaggagattttggattttctactagtgctagtgggccacaccaacaactgcaaagtagggcccattttagcagtgtagttgatgatcatagtgggcctacatcattgagtaggttctccgaaggtgacgatgggcctaactttgatgaaaaactgggcttggacttgcatcttagtcttgctccagctgggccatga

SEQ ID NO: 852 - protein, 247 aa, Populus balsamifera subsp. trichocarpa
  misc_feature (1)..(247): Ceres GDNA ANNOT ID no. 1463957
  misc_feature (1)..(247): Functional Homolog of  Ceres CDNA ID no. 12724333 at SEQ ID NO. 849 with e-value of 5.79E-50 and percent identity of 57.5
MAELDYETKHNSTSTRLKLFGFNVSEDEEQITTTDSLKSSSCNSPDDSSFATATTTVPATASGDSRKYECQYCCREFANSQALGGHQNAHKKERQQLKRAQMQATRNAAAAAVSFGRNPMISAFAPPPHLLAQAAGQVMVPAASPSWVYLPRAATPFHVSHGCVFPSGVSGRGGGGLPYGDSVGDFGFSTSASGPHQQLQSRAHFSSVVDDHSGPTSLSRFSEGDDGPNFDEKLGLDLHLSLAPAGP

SEQ ID NO: 853 - protein, 211 aa, Zea mays
  misc_feature (1)..(211): Ceres CLONE ID no. 1688030
  misc_feature (1)..(211): Functional Homolog of  Ceres CDNA ID no. 12724333 at SEQ ID NO. 849 with e-value of 1.09E-20 and percent identity of 52.2
MHRSMAADIKCEQPKRTPSPSASSLRIFGYDVAGTGIADHIIEPPPQDDGRPAVVGSRRRFECQYCCREFANSQALGGHQNAHKKERQQLKRERQFAARALVGGPAAAGLGGICAAGFTSSQSQPPPGHIIAVSPGAIASWVYLANQPAATMGLPFHAGVCQPEPLMLRGGTGSSILRRSYELCAPADDDLEESSAMGLDLHLSLAPASSS

SEQ ID NO: 854 - DNA, 624 bp, Arabidopsis thaliana
  misc_feature (1)..(624): Ceres CDNA ID no. 12729193
  misc_feature (1)..(624): Also Known As Ceres GEMINI ID no. 5109A11
atgtcatctacgaagcaagcaaagggaagaaaaacaaaggggaagcaaaagatcgagatgaagaaggtggagaactatggagataggatgattacgttctcaaaacgtaaaaccggaatttttaagaaaatgaacgagctcgtagcaatgtgtgacgttgaagtggctttcttgattttctctcaacccaagaagccctatacattcgcacatccgtctatgaagaaagtggctgaccggttaaagaacccttcgagacaagaaccattagagagagacgataccagacccctcgtcgaagcttataagaaacgaaggctccacgacctcgtaaaaaaaatggaggcgctcgaagaggagcttgcgatggatctagagaagttgaaactgttgaaggaatcgagaaatgaaaagaagttagataaaatgtggtggaactttccttcggaaggtttgagcgcgaaggagctgcagcaaaggtaccaagcgatgctcgagttacgtgataacttatgcgacaatatggctcacttacgattgggaaaagactgtggtggttcatcttctgttcgtgtgggacgtcgagtttctggtggtgttcgtctgttcgatcgtgaagcatga

SEQ ID NO: 855 - protein, 207 aa, Arabidopsis thaliana
  misc_feature (1)..(207): Ceres CDNA ID no. 12729193
  misc_feature (1)..(207): Also Known As Ceres GEMINI ID no. 5109A11
  misc_feature (21)..(71): Pfam Name: SRF-TF Pfam Description:
MSSTKQAKGRKTKGKQKIEMKKVENYGDRMITFSKRKTGIFKKMNELVAMCDVEVAFLIFSQPKKPYTFAHPSMKKVADRLKNPSRQEPLERDDTRPLVEAYKKRRLHDLVKKMEALEEELAMDLEKLKLLKESRNEKKLDKMWWNFPSEGLSAKELQQRYQAMLELRDNLCDNMAHLRLGKDCGGSSSVRVGRRVSGGVRLFDREA

SEQ ID NO: 856 - DNA, 1966 bp, Arabidopsis thaliana
  misc_feature (1)..(1966): Ceres promoter ID no. AtATPEN
tgccaatcgaatggtgattgaccagtgatgtgacgattttgaccactgaattcttttatttaaagtcaaaactaaacaagtcatgcaatattatataaaaatggacaataactcactataactttttcatttaatcttcaatgaaattatattccaatcttcttcttgatattttttttttcaatatttgtttcattatacaaaataacaaaatttaatatgtgcatgacaaattaaaaactttacttttttttcatcgagttataagatttatacagtatatggtttgatctgtcttttctcttgagacccggtgtaacttcaaatggatatctcaacctcggttttcagttttcaccttccgctgaacggatccactggtatttattcggttctttgaaaaatgagacaatggtgagaacgaaataaattccttcaactctgctagatttaagttcaaacccttggtcacctatagttggtggaaattgagctatctcgaaaggagttcaggcttggtagccttggccaaaagactttggagtttgagcaaatggtcaagaataaattgttggcactaattaaggtttaacatgttgaaagtaaacatgaaattggcactaatatttttgctcttgtagaagatatatgagtaatttgacttctagttgaaggctcatttttttttaaagattaagaggaaaacggctatttacgtagcatactactctaaggctctcatgaatcatgatcatatatattaatgaactaaaagtgtcatgcctaaaactacatgaacaaaacaatattatgaatttagtacatgacctatttaaatatgtagtcggaaacctacgttgaagtagatatcattacccaaactattagtgctttcttactagaataccatgttgtacaataaaacgaatatgttttacgaaaacaaatcggtctcctcgaaacgatattgttttatttgttaaatttgacttcagttaaaaaataatatatgaattagattataccatgttgtttgtatttcaccatgtatctcatccttgtatttcactttggttgcttttttttttttgtcaaaccttgctttcattcagtggaacaaagaacaattacaagtacaagagttaaacaacccaaaggttaaaacattacaacaagaggtattccccaataccataaaaaaaagatagagttcatcgatttgaagtccatgtatctcatccttgtatttcactttggttgctatttcatgaataattcagacggaaaaaaaaaagattataccatgttgttttgcgtctccctctcttctctctcctctcttactccaatttcaccactacgagttagagaaagattctaacgccgataagtatgtttaatagcaagtgtaaataagagatcgaaagataaatccaaacttcgtatatcgatttaaatagtttttattttatttttatttttcaattaaacttgggtgagaaagtgagactgtataagtgatagcaaggtaaggtgaattacttaaatatgtgagaacgtaagacataaatttaaagttcaaagcttaaattgattaaattacggaatgttgaagtttaattttttttttttttaaatttactttataaaagttatttgattaaaaaaagtcattaaataaaaaaatcatagaaaatcatatatatacttttaaaaataaattatgtaacggtaattactaaaatatgattaatgatttcaaaaaataaaatatcaacttttagaagatgaggatatagtactataacgataaaatatgggaattattaaagttatagttattaaacaactagatagtagatacactagtttttcccaacatgcatgcatcgtcagtttctttcttatttatatgtatagggtatcgcgtattctttcattccgaataaacttgaacgattgatag

SEQ ID NO: 857 - DNA, 1373 bp, Arabidopsis thaliana
  misc_feature (1)..(1373): Ceres promoter ID no. AtLUP1A
ctaacaataaacgaatcgtgcaccgtatttgatgcagagtggacaaatgttcgtataaaaatgtaggacgcacatgatcgttatgatctaaatatagtaatttgacaaaaacatatgtagtgagagtgaaagagagctaactcaatttgtcaatcgcaatttacgcttatacatacggccacgtgtaacatgggatgcgtaccacagaaaaagctttgatctcttaagtgcgaccgtatcgtttcttcttgcggtgtggtaattaagtgcgaccgtatcgtttctaacttttttatacggcgtttatttgagtggtctctacactctccccaagtaaaatcaaattaaagtgtttttaaaagtacacatattctctattaagttgcatgaactaaacaggtggaccaccatttcatttgttaaatgagtttgattatatatatgactttgatattgtgatatgggactgattatttaattatatggaacctaactacaaactagctagtattagataataagaactaatatctgtttatcataatgagcaaaaattcgagaagtcttctgagttcatttatatatactcctaaaagcaaataatacgatgttatcgcaataagacattattgagaaataaaataaaaacctaaaaacaagagaaggagagaaaactttgtaactacaattaagctgcgtagagttgaagagtgtaattttcatgtcaacaactttaagctttgtctttaatgttcgtaaactatacatacttagaccatccttaatggtgagtttttacacaaaattcttaacattttgatatacaaaataataattaaatattaaggggctcttaacaagaagagagaatgtagcaaatatctcttatctaagaaccattttcctcttttaagagtcatttcttatattttaaattcttattttattttatataatattttaagaaattttttcatattcttaagaactcatggataatgatgctcttacatactgtacatataatatccccaaattattcttattcaattgtcatactgtatggaggcctacctctatatatataaacatacgtacatgaaactccccaaagtataatcatcaatcgcaaaacaaacatcgacccagcacaagtattctctcggtcactctcttatctctcttaccctctctccatctcatattcataacataagggatcttttaatacatggtttttttatctatatataccgtacgcctgtttacaaactggactctctaatatactatcatttgattatttctatgaaattctaaactcgttgagtatatatatgtacacgtaactatacatagctaggaccatcgcc

SEQ ID NO: 858 - DNA, 1519 bp, Arabidopsis thaliana
  misc_feature (1)..(1519): Ceres promoter ID no. AtBASL
tgattcttttcaagcaactatatccgaatcacaggacagaagagatcaacacttccatcaagaaagccgtgcaatacatagagagcatacaaatgcttgatggttcatggtattatataaattagcttttagatacagtgaaactgttcacaaagattttggttttaccaacaattcttggattgataggtacggaagctggggagtttgcttcacatacagtacatggtttggtctgggaggccttgcagctgctggaaagacatacaacaactgcttggctatgcgtaaaggcgttcatttccttctcacaactcaaaaagataatggaggttggggtgaaagctacttgtcatgtcctaaaaaggtaataatcattgcaatgtaagcgtcttttccccagttcccgcgagtcaagaaaaatatacttggtttggtgtgcagagatacattccaagtgaaggagagcggtcaaacttggtgcaaacctcttgggcaatgatgggtttacttcatgctggacaggtttataatatcgatatgctgagacttttacttcctcgctatatgaaagatcttattcaaagtatttaattgttccttttaatctcacactacaggccgagcgagatccgtctcctcttcaccgtgctgcaaagctcttaatcaactctcaactggagaatggcgattttcctcagcaggtacttttggaaacatgaaacaaagctaacacaaaaagctgctcatacaaaaaccttagagatgccctcacgatgaaccataacgactcaaattttatctggtccttttgctgcctaaaattttaactggtcctcgtgagttgatgctaaaaaaatgcataacgtttgaagagtcaatattgtatattttacaggagataactggagctttcatgaagaactgcttgttacactacgcagcatacagaaacatcttccccgtgtgggcactcgcagagtataggagacgagttcctttgccgtatgaaaaaccttcaacagagagaagaagttagatccatcagaacgtctcaaaactcacaggtcattgaccatgatgtaggatcattaagtcatgacctctattttgcaataagctattatttatatgaaggtggttgagtattcttactgaataagcaaactaatgatcgtgtatgaacatacacatctaatattatatgttcatatgtattatattcatgtattgtatcatgattcatgactatgtatgttctcaagtaatataaatgtattatattatatgtatgtagttaagtacgtatccaagattaagcaaaatcttttccccaacaagtactctcatttttgtcttttaattctctatcatcccagaagtaacatgttcttgtcggtgttttcttatcacatatttaccaaaaatctacccaccttatcttaacttaatatacttccacttatataatctaatgtatgcgtttaagaaatgaggtacgtagctcacattttttaat

SEQ ID NO: 859 - DNA, 1759 bp, Arabidopsis thaliana
  misc_feature (1)..(1759): Ceres promoter ID no. AtATCPS1
acctaccatatgtcatctagtgatttgtcgtttttccgaactgtagtatttcattacatgtcgtttgacattaaatgagattcatgtttggcatatttgcatcaaatgcgttttgttggaatgttcgaattcgttaatactatgtatggtcaagttaacgatcaagtatttattgttgtcgttataaaccgttattagaaattttttctcctgaaaatgttaattttgcaaacctaatctaccacatgtcatttaatgatttatcgtttttccgaacggtagtacttcattcaataacatattgtttgacattaagtgagattcatgtttgacatatttgagtcaaatgtaatttatagaaatgttggaattcgttaattttattgtatgcacgttaacgatcaattatttatgagtatcgttataaaccgttatcaaaaataatttctcctaaaattgataattttgcaaattcgatcaaccatgtatcatttagtgatttgttgttttccaaaactatagtatatcatttcgttatatatcacaaaatatgataacatctgttgaaagatttttacagtttacaaatacatttcctgatataactatatgtaaattatatcatttcgtatatatatatatatatgtttgaataaataatttaggcattattttattttattttatttaggcatttgatgagtagcaagactactgtaattatttttaaagctattgtcacgtaacaaaaaaaacgtctcaactctatatttgactggtagtaattcaaatttcaaatagttatacatgcaataatataactacacgtgtactttctacttcctaattttataagtatggaatccatgaaaaactggaaaaagatagagagagtctagagtcttaagataagatgtaagtaaaaggaagaaatcgtaaaactcctctttgaacttgacaaactaggaattactaccagattgatactgttttgacaagagattgtaatataccatctacttctaattcttatctagaccgagacaaataccatttataaagatttactgcaatattagtaatgtattgttacctgtccacacgacaaatatatcaatccatgtatttagagtttccggtaaacagaaactaatttgttacttaagattaaaacaaaataatcttaaacttgacaaaaaaaggaatcccaaatagattagtaccatatgacactagataagtaccatccttttttttgttttttacaccaagacaaatttataataattctattgcaatagtcatatatgacttgtcacacgacaaatattgtttcctaattatcttttacgaccttaaaaattattgtttgtgatatgatatgattagaagccctcgtatgtgtatgtgtgtgtgtactttcaaagatatcgaccttatgccattatttttataaaaaaaaatcaagttgtaaaagagatataaacaagagaataggaaatagaagaaaaagccaaatttacccttcaattccgtagctttggaagatcccacaaaaacacattccatgcatcatatccttctctctctctctcttctttctcaaagagtaaaatgaaacacaatctctgatgtgaagtcggttctgtccttataaatacccattaagacttctctctctctctctttctcaccaaatagtttcatcatctcttcttcactaaatacttagacagagaaaacagagctttttaaagcc

SEQ ID NO: 860 - DNA, 1515 bp, Arabidopsis thaliana
  misc_feature (1)..(1515): Ceres promoter ID no. AtDXPS
agcttgtcatcttgcatttcaagcagtttcgacaaaattttatccaactgttatattcaaactaattgaaaatcgaaaaaccaccattaaaaattagttaaaaataacatatcattttgaaaatgcaatatttaaaaatttaacatatcaatttaacatgcttgttttcttaataagttttgatatattataaaatgaaccgcgtgattacaatttttctttttgtgatggaactgtcgttagttaaacacttaaacttaaactttcatgtaagttttgtttattcatatttgactcaattgaaacccaataatcaagaatgtcaaatattatatgttttgtcggatttgtaacgtgattctcgctcatttaataatgtgataatatcataaaatttaatctatgtagttgtttaatatgatattaaactttattaatgtaataagatcgataatactaagttactaacccaaatcatacacttacgagttacgacactaccgcactatcttggttatattaaatactccttttgtttctaatagtttgatgtttatatcaacattattatttactttcatttgttaccgatagaaagaggagaaaattgttgacaaaaacaaagaaaaaagtaaaattaatattattaaattaataaaaataacaaactgtaaaagctatttttaaaaatttttcttgtaaaacatctaaaaattattcttgtagaaacagaggaatatcattgaagataatagtgtgaaattatatatatatatagaaatatataaagtaggatttttttctgtatacaaatatacgtttccaattttatcaaaaactgtaaagatttttttctttgtcagtacctgctaaacttgttaatttttttattaaaaaaaaatcaaattacaattcttctataatcattttaaattccatttctttataccacaaaagattatattgcctttatcgtctttggtatgtatgcgtgaatatatttatttattttcttttctttcattttctttttaaagaactttataaatgaaataaggaacaaacaatatacacatgtactaacgtatataaataatatcatcaatatctatccaaaacttggatttcatggttgacgtggcccaaccaaaatctcaagttctctgcggatgacgaaccatctcaccatctctttttttctctctcttttttttttttaatatcatcagcacggttacataaaattcgtgatccatgaagttggctttcttgtcgttttacttcatcaccccatttttttaaagtctccatctttatacttcttcaactctccaccaccaccattgtcaccaccacatttaaacacacactttcacttgtagtgggattcgaaagtgcgttttattcatttgttttactgtttttgataacctcaaaatttgcctaaattttattctctataaatccttatatgttttacttacattcctaaagttttcaactttcttgagcttc

SEQ ID NO: 861 - DNA, 1291 bp, Arabidopsis thaliana
  misc_feature (1)..(1291): Ceres promoter ID no. AtDXPR
aacgcattaattcaggctccgatttccgatgtttaaagaaaaagttgcatgcatgacttgggatggaatttgagtggatgcagcaagtaacacttgtttaacgtctctttcactgttttgccatgtgtcacttaacgtacaacacttgtcctcagatgatccattagcagtagtaaatgatttactgactcatctaccaataccaacataccattatcttaccattatcatttatctattgatctctgtatccccacgaaaacactatgtaatgtgatagtcaatcataacagcttaatcacacttaaataaagtaaattatcttttttctttttcttttctttttatgggataaattttattcctttccgaagaaagaaaagagagcaccattcaaacaacaataatctttttgaacggatgatctaatagtctacaagaagactaattttatttaaacaatcgaacctaacatgactctaattagagatatagagaattatatacgtaaaaaattcaagttggttaaagttacatggcttttgaaatttaaatttacaaattgaacattgaggaacatatcaaagaaataagaatgatagtgaaaaatgttgacaaaaaaaaaagaatgatagtgaaaaatattcaatacataatttttaaaaagaaaagtatattatatacttgtcaaagatctaaactaagtttgacatttggattataattgttacagcatataacatgtactttataaaaaaaaaaaaaaaagagaagaagaaaaaaaaaacatgtaacatgttttatttttgaaaaagacagcatacaacatgttagtcaaaacatattcaatttaagatattcatatcaaaaattcataatacgaacgaataccataaactttttcttttttattttgtaagagagaaatccttaaccattaatcccttgtaatgcatatttctaataataattatatttgacaaactatataattgatgatacagattctgctgtttaatactctaaagaaatcaaatagaaaatgggaacatagtaagactggattatttaccacttacaagttgtcgttaccttaataaaaaggtccttgttactaaatgctcagcgaaatctttaaaaaatgacaaaaatctgttgggtaccattcaaatccagattcctttcttatcatcatctctctctctcacactgtttatctgattcgtcttctctgataatcaagagtagtagtgcggttctctggaaaatattcgatttttaaaagactccc

SEQ ID NO: 862 - DNA, 1393 bp, Arabidopsis thaliana
  misc_feature (1)..(1393): Ceres promoter ID no. AtFPPS
tatagtagttaatgttggggtctagtccaactacaactgctcccacctgtcacaggaagtcatgaagaaatatacaacattagaacctagagcaaaagagaataagaaaaacgcaagattggagaaggaatcaaagtcttatggcccattacacttttatcatgttcaaagagagagtttgatttccattgtgccttcttttcaccatcttcctgcatggaagcaaatactgcttcagatagacagaggaattcaaattatacaattttggttggtttaaaaacacaggagcagtaagtatcaaacatcttgtacaatgatatgagtcctcagagtgaccaaaacatgacctgatcaaaacatataacaaaaggaagactacttacaggaccaccaagacctgtaaaaccggcaatctgcagctcctcaagaacaccctctccaccaatcacataaacctacaaaagcaaacacgaaaggaaaaaaaagtgagaaaaagatgacgatagagagacataagccaatgtgtcagtcgaagtagaaccttcttgtccttaggaaagttattgactttgagatacatagctgccgcaaatgacgaagagaagatctcatccttccaaagtaatcacatttttttgttttagttttaatggtaatcacaagtaatacgaagaaggagaactcaaagtttacctgagtaatagaagtgacacccaaagatcggaacttttcagcgtattgcctcctcgattttacggaattgttggtcacaaagacaacatttttaccctgaaaatcgcaaaagatcagagagagagagactgaaaaggaatagagagtggggaaaagggaaagcaccttagaacggataaggtcgagagtttgggagacgccatcgatgagcgtttcacccttccatataacacctgaatcgaatcatcatccatcatcagagtagtaactaaagaggataacaatcgaatggaagaaagtagaatctaccatcgcagtcgaagaggaacgtatcgacagagtcaaagagagatttgaagttactggaggagagaagctgaggcgccattggaggagtgtcttcttcttcttcttctgggaattgatcactctggtaaagcacaattggcacgtccaaaacgacaccgttccatcgaaagaggccacattgtgattggtgagcccaattaggaaggcctattttactaatgttgaagcacatgttgtactataaaaaaacagagtttattatctgtttctttggcttgacatgacaaatgtacaactgggagagaaagtcagtccgattgtgttggggatgacgatggcaaaagtagtaaataaggaagaaacaggaggggcgttttcgggagaagaa

SEQ ID NO: 863 - DNA, 1899 bp, Arabidopsis thaliana
  misc_feature (1)..(1899): Ceres promoter ID no. AtHMGR
attaaaaatggtttgccctaaagatattctatgtttttttcgtgaataggtgttaaggatattaaacaaaaatacccttatttattcttacgactatcttgtgtctatagcactctagcttctacgttggtatcatttatattttaaaaagattttgtgatattattatttactggtataaattttaaaatttctcacgtttaataaaactaaacatattaataatttaaaattattttacttttgatttttattgatatggttgacgaaaaagagtgattagtaatggaagtttgtctggatatgcatttttttttcttcgtaacgtgtatctcgttataagaactcatatgtattatatgagccaaatcaaatcgtgtgtattaaaattggttgccctaagaaaattcaatgtttctttcgtgaaagaaagtctattttttttatagatttgattctcttcttgggatttccacattaaaattattatcttagaggctcagtttgatacatacactatattttttatatattgttcaacgtatagtgactgaatggtagttgtttaaaaggattgtgtaaacgagttggatagccaaaactatgttaacttgatccttgtaaagtaaacaaagccatgcatcctctaattcaacaatttggtcccattaccccaagaaaatgttataaagaggttatctttatcaattacttgtaaacaggacattatctttataaagaaaatgatatacatgctgcatttttttggtttggtagttttacatgctgcattttgtacttgcaaccacttctatactaattgttttagataagatagtaccttcttgtttgatcacatcgtaaaaggatcggatatgttaaccgtctttttccaaacgttatatactcttcaacactcatcataatgtatggagatgtatcaagtatctcttacgaccattggtctttgcggcctaatttgcaacagaaagtcagaaatatccatactataactatgctatttgaaaattattcattttgactcatatataaagtagagttaattaggtgtatagccaaattatggatgaaaattagacaaatgatcatgacattcttttttcttaatttcccaaaagaattgtaatatcagaagggaaaaatacattccacacatagttagaacttagaagaggtccaatcaataggcggtaaaaattaatttgtaacggtaaacaaaaacgataaaggataatagtacaaactaattggcaattaatactgtttttggtcaaatatatatgtcacgacagtagatgaaaataccgtttttggttgaatcgttttattttttactttgtcttgaatcttgtctactcttcaataccgtttttcgttgaatcattcaaaaaaaaacagatctcctagtgatatgaatcaaagtttatcaataaaaatcttagtatacatttgcaaaccataacttcataattttgaataaacgataatgtaagacaggttggctcattagaaagcatatcaaattaattgtaaggacacaaatatctataattaatgcaggcttttatgaatcaatcatcatcattcacatcctcgtataattgtctaatttcgtacctcaaaaaaaaaacaacaacgtgaaaacctaaaattagatgagttacgaaaattaggcaaaaataaataaactaaatcatagtattacaaaacaaaatgaaaacgaaaaaatgaagaaaaagcaagctggtccccaacagacatgcgagttcgtctcctataaaactttgttaatctctccttcacacttatcacgccacctcaccacctctctcctctctcctctctctcccccctggagagattattcattccctccaa

SEQ ID NO: 864 - DNA, 1824 bp, Arabidopsis thaliana
  misc_feature (1)..(1824): Ceres promoter ID no. AtGGPS1
atggagcttcatgtggatacacaggagagacttggaatgtgaaacaaacgtaccattgctgtttatttggtaagaaagaaacaaataagtttccaaaaagtttttaagagacaaaaacgcaggtttcagtgggaaaaaaagcactacttaactggtaatatccatcatcaggtttaatggatacttcaaagttcatcaaatcatctttgccatttggaaaagatattgaacaagagctaggaaggttcaactctgatatatctgcacagttcaaaatcggaaaaaacaccaaaaattgaaacttggagatgcaagaacaaaaaaaagatcaacaaggcatttatatacctttgtgaagacgaagttcgccagcagattgcttcttaacagaagctcctcctctagtagcattttgagcttgttctctttgcttttcctttactttaaacaacccaatcattgtttctgacttctcttaagaaactcacacccacacacacagctgtgacaaatcaaagaatgaatgattaattctatgacagatcaaagaagaccttaaaaaatcgatcctttcgatatatcaaatcacaactgcaactaaactcatatgcccacttttatattaatcttggtaacatagcttattagactttcacacaataattgaatcccaaatcataagatccctaaaacaaagctataaccaaaatctcagaaatgaaaacgcgttattacaagacaagctaatctactttaacaggttcaaagatcgaagactttccttccacataagtagaatcagaaatctcaaaacaacgactaggtcgaaacatcgaaagttaaacaccaagacaatcaaacaaagagaatgaaggaagaagaagaagaagcttacaagttgttaaattcgttgcaaaaacacgaaaatcaaaacgaattacgagcgaattaaaaaggtcgccgattgattaatctctctctctcgcctaccggattgtcgtcctctgaagctaaacgacgaagaaacagcagagaaatggttgcaataataataaacacacaatcgtagcttttttctcgacgctgaatcagaataattcaaaaatctcgtacctgtttgttgagttccagcttggcccattaaagcccgttaggcccatttcagttatatctatcttccaacaataaatttggtagtttgcgcgcttttaataagttaaaaccaagcagttgtcagagatcaacgagctcgtgtaaaatgtccacaagtgggacttgtgacccgtatgcattttttatgccatttttactaatttcgtgtaacaaatctacaaaacaagataatcattaatcactacgtaatcatctaaattcaatgtgtggtatagaaaaaaataacagatgagatttatgtgtttaagattttgatattttaccaaaacaacaatagtatatatttgtggtatagaattgaaaataaaaagaaaaaaatctaaaaaactgacaagtaatttatctgtaatctaagccagaaaaatatcatctttatgctataaaaacattttccatggacttaaaaacaataaaacaaaaacagtgaaaaaagaaaaaagatgcttttcaataaaagtgaagatcgtcatctccaccactaacaaggcccattccgtaacacaaccctatctgttacttcctagcttctcactaatggccaatccaattctccattcataattttgactccactttccaaaaaaaacaaaaaaaaataaatactaatataaaaaattctcaaatctaaaatttcagatttcagaaatcgcc

SEQ ID NO: 865 - DNA, 2275 bp, Arabidopsis thaliana
  misc_feature (1)..(2275): Ceres promoter ID no. AtPES
accttctgagcgcaagagagagggccaagttgcgaagacagtatgggacccaaataccgactaagcggaaatctaacttttaacttttcctaccaatgaaacattgacacgtggaaaagcaacgtcgcccactttaccctccgcactttgaaatctttgataagcttatcgctctcccattggccgtaggctccacgtggcatctctctgatctctcttctgctaatccttttttacccaaactggcatgaccccacccctaaacccctattgtcctttctaccaacaattacttaatgacttatataatattctaattatattttaattatgtaattaaataactattgatcccatctccatagtgacatgtctcactttttcttccacaacaaaatgcgtcactcttgattcatcatgttcgtagcaaaatccacgttattacaaaaaacgttatacattttgaaaggtaatccataaaatagtgagatggatcaagttttctacgcaaccctcgtagaattttagcaatgatccaaagctactgtatatatatagttacgtttcgtaacacaacatgtattttaccatgattatgcctcttttttttttctttccacaacatatatgtatttacatccttatttggtttaggctgagtttgttaacatagcatcaccaatagggacaatttttttttttattacaatctaaatatctaaaatataaattcacatgaaattaatgtttctaatagagttcttcaatcttcatgtacaattgcacatttttgtgaaattattattactttatcattttttctttaaaattaattcaccgagtaccgataaatgtttatattgaatacgatttagtaaacgacatatatgtttcgtcacatttttatcactatttgtaatatatctgttaaatttgatgatgtagtttctgtttttgaattgaaaacttacaaagtttagaaaaaagaatgtaaattagaaataaatacactttctgtatttttgaatactataataggctaaaatcacatcattttctaatgttgctttaaataatatatatcaaataaaggcttaaattacatttatataagaaatattgtaatacaaatatcaatttagagctattaatttacaattacaacctgttgcccaattgatgaataaatcaaacatgtaattaaccaaactttctaattgatcaggaatcaatttagctaaataataagacataaatttggccaagaaaaagaagagaaaacatgttaaataggtaatgggttttaatattgggatagttacctttatttgaaaactattaaggtttgatttaagacacgagtcactcgagagtcgcatctcgccagtcaaaaactaaattaaaaaactatatagacccaaaaaataaaaataacgacttttgtatttatactggcaagattctcattaaaacccagcaaaaaaaaaaaaaaaagacaaagaaggaagaaaatttgagtgggtgagaattttttacgatagaggaagagacagcatcatctacttgtgttgtctgtgtacatatattacagtaagcgttgcaatataacttcttgaggatcttctcacattaatgggtcaaaccttttgctcttccttttgattaatttagtgtttgacaatctcctcctccttctccttcttcttcaaagttttgtcgcagtatctattgttcttacagagagaaaggtaggcttttgtgtccatcactcattttcgctcgtttggttaagcttcatctgccatgtggttcactgttttgatacttttgggctcttatacctaatgttgatgtaacacaacgatacataatctaatttgttttcgagtggaaaatagttgaacccagttgagtatttagccaatacgattagaggatttacttgttttttctcttttcatgttcttcatttgcttttgaagatcttcctctttatgtttgtgtctcttcgctattttacttgcttgaagaaattgagtttctcatctcgcttaaatttggctttatatacagatttagagatctcgattcctaatctacttgtttttgtattcaatttgcaggaaagctttagtcttttaccagtttgatccaattctgggtttcactgaaaaaaagttgggagtttgattcttctaactgtagaagaaacagagtcaacagaagaaaactaaaaaagttgagatttttctctcacgcgctcaagaacttgacc

SEQ ID NO: 866 - DNA, 1404 bp, Arabidopsis thaliana
  misc_feature (1)..(1404): Ceres promoter ID no. AtGPPS
aaccattcgattggcaacaatctcaatccacattcttatccacgaaaccaaccaccatcaaaaccaatctccatagccatcctctcttcactgtagctgatcagacagtaaccctccagatgaaagagaagatcctctgtctcgagctaatgggaattgactcaggaaaagccctttctctcaacccatgtctctgctcagccccccttgactccatccaatccgtcctccatttccttcaatcaaaaggaatctacccaaatgacctcccaagaatcttggggatgtgtcctaagatcctcacttccgacgtcagaacagaactgtaccctgttttcatgttcctgtcgaatgatctccatgtccctgagaatgcgttcagaagagtgatcaagaaatgtccaaggctccttattagcagtgtagaagaccagctcaaacctgctctcttctacttgcagagacttggtctcaaggatcttgaagctcttgcttaccaagatcctatcttgttggtgtctagtgttgaacacactctcatcccaaagcttaggtaaaattttagccgttttcttcaatgttactagtgattagattagagaatctgcctttagtgttgttactaaggacatttctttttgttggtcagattcttggagagtatagggttctcaagaccagaagcgattggaatgatcctaagatgtccagcattattcacattcagcatagagaacaacttcaaaccaaaactggattacttcatgagtgagatcaaaggaaaactagagaatctaaaggagtttccacagtattttgccttcagtctagagaaaaggataaagccaagacacttagaatcaatggagagaggattagagttgccactgtcattgatgcttaagagcactgatgaagagttcgagcagttgctcacaaacccctcttcagtggcaaacgtgtaacatttattgtatagtggtgaatgttattgattgtgttcatagctttgttgtgtacttgtgtaaaaaataaaaaatcaatttggtgaaatattcgtttgtttcaactttcaaacgtgggctaaggtgtgtattattgggcttaaagtgggcctcttgctaggaattttatgatttcgcggttttacgaaattaatataaaattaaaaatagcattaaacctcaggactcaggagaagccctaaaaaggcgttgggtaaattgactaccttagcaagtaaaacagtaaaaactgtgaatatttacttacattttcatggctgaggttcgtcttcgtcatttaataaatttcgtaaattcctgagtcggctgcgttctcgacttgggttcgtcttcttcttctttctattcagattcacaataattgccaagcgaacaagtc

SEQ ID NO: 867 - DNA, 1817 bp, Arabidopsis thaliana
  misc_feature (1)..(1817): Ceres promoter ID no. AtATTPS3
acattaaaaggtatttggtttgccggaaaaatgatcattttattttccaaactatttgtaattaacacaattattttttaattatatgtgcgcaaaattgatttttaatttgtcgttaacttaacaatttggtccaaaatttgatcaatgtttactagttgatatagaaacgttaaattactcgattaaaacctaataaactcaaaaaatcctaaaatttctcccaaattgaaagctaagtcattacttcgaataaaaaaaaaaaatcttcatctattcatcgtacttcgccaaaatatgcgaattcgattttattatttagctgaaattcatttattactattttctgcatggcaatgtttcgttaattttttactttcaattttattgtaattttaattcaaattataatatatgtacataatttaacaatgtgtttgataactttctctaaaattgttgtcatttattatttatacatagatatcaggaccggtttagagtgtgtgccaagtgccaatggtgcatttgtactgtttaagcaatcatggtcctattttctcaaaaatatataataaatgtccaaatccatacataagatataaacatgttttttataattagatacagggttctatttttctctgagtcggccctgatagatacatactatcagattaggcagaggtatggactatggagtaatttatgggggcacatccatccgttggtatgatcaaaatttagtataagtcttcagaaagtattttttagatgggatgaatttgcctctctattatcccaagattgaatccccatttccttcagaagcagtaaatacaaattaaactactgagctacaaattcgcgtaaagctacatgtgtatttttaatctcaaagttgctgtaattatgaaatgtgaacgaaatagaagtgacaggagcttgagtgccccatgagataagaacttatagatgtatattaatttaaactgtactgtctaaacctagacaacgccgtgacgtctttgcccacatgtgattattcgttaccacctctcttagtgtggtccaacaaaattggcctctcagttttcattgaaggcagggatagagatatacaggtagtcacatggacaccgaatcgatatttattccttggaatttcattaaggtttttcgaaccaagacaagacaagctatgcatgaaaccatttgccatgccattaacgtggactaagggtggacactgatctatctcgtacttgttattaataaaaacaaccgatttgtttttgtttttgttattatatctcctactttttgttataccatgcatgtccacacgtttttttcaatttgttacatgtccacaactttcacaaatatttttaccaaaaaaacaaaaaaaagtttgacaaatatctttagattttttttttgggcaattagtgacaaagcaagggacgttgaaagcaagaaacgtaaatgtttggatatcacaccacaccaatatgttttagccattacttctccaagtttttttgttgtgtgggaataatacttctccaagatatttaagaaaacgcaaatgcatggtcattgaattatatagcgagaaaacgtcaaaaactaaactgattaaaacagatattcttttagtaaaacagaaaaaataaaaatatcttcatatatataacctgtggtccgagacccaaaccttaaatcagtataaaatatcatagcggagtctaaagaagagttcatccaattatttaactctttagtgtaatcattagcaacgcaaagaaatgccc

SEQ ID NO: 868 - DNA, 2957 bp, Arabidopsis thaliana
  misc_feature (1)..(2957): Ceres promoter ID no. AtHMGS
acagcgaagatagtgaaatagtatcgaacctacctaccccgctcacgtgtataaccacgagttttgtgcaaccatcgatcgtgtcatcacttttatgtcccacaaaatcgtgacgtcagcgtaatccgactcatctctcagagacggtctgaaattggtacattctttaatgatgtttgaccatttttagtaaccaagtcggacggtcaggatgataatgagatctcaatcggacggtggcggagattccaaggtcttagggagattgttgttagctttaggaaaacgacaatgttttcacatgtttcaaagtccaaactcattgattccaaatcacaccatgttctgtctgatctagttaacagctaatcaccaaaatattactgtatcatgtataaatttttcgaattatctgaaaggaatcgatctctgtcctacacttacataaaacaatttacacctaaaatgggaaccactaatctataaaacttaagttttatttatttaattttttggttgagttttttttgttgttaataatattttgtttttacgtgatgtttccacttttcatgttgttgaggactataacatttcaaaatctccctattaataaactagattacaaagagaatcaatactagtgttagaatataaaaaacaaaattagttaaggaagtttattgatagtgtgaattaatgtataactcatgactttttcatggtgttgagttggttcggagttaatctaatcaattaatggtatcggacacattagcaatccaccaggtcgtaggtttaatttaccgaatatcatatcttaaattacttctattttttcagaaaaaatcaatatttctaatcgcatgtaaaatgagtgtatttaattaagagagaaaaaaaaacatatctaatcgcatggaaaatgagtgtattaattaatcctcttctttaaatcatattcttttttttttacaaaatctttttccatttaatttaccgaatatcatatcttaaattacttctatttttttagaagaaatcaatatttctaatcgcatgaaaaatgagtgtatttaattaagagaagaaaacaaaaacatatctaatcgtatggaaaatgagtgtattaattaatctccttctttaaatcatattctttttcttttacaaaatctttttttatttaaatgaaagttgaagttcctaacaaaattaaactataatttaaatctatttttctctttctaatttatgatttcttaaatatgaaacaaaaaagaaaagataaaaagcaacgaaaagaaattcaaatacagacttataagtaaaattatactatatttctaccaaaaaaaaaaagtaatttatactatattttttaattatctttaatacttttttatccattttatttattcaaaaacaatccttaattccaaatagattgaacttaactccaagttatctcaccaagttacatcagaaagctactctatcatacttatcaacaaaccaattgaatccaaaacataaaccaaaccaaaaaccataacaagaaaaccaaaaccaaaatttaggagtagcgaattggtaaattaacgaataagaaaagggtaaaaaaggaaacaaaaagaagcacgagggagagctaactcacgaagtctgcgttgtccagattccggactgcaccaatctctcacaagtcacaacatatccattttccaggtaattattatttgacacctttttttttttttgttcttgttttttttttggtaggcttttttgtttgttcacatgtagttgtccccagaaaaatataaaataggttaattttgaaccaaaaagtttctttaattacacaccaaaaattttataattaagtattgattccaccaataaatatatctggcatgtttcagttagtttaaacaaaaccatcaaatttgaaatttaaaatttataactaaaaaaatgaagaacaactgtacaagtattttgttgaccaaatttaaaaaaaattcacaactaattataaattaaatttttttattaggaaaataaaaaataaagaaagaaaatctgctaatttttctcgtggacttgtttattaaaaacaaattgagttttcatcatcaaccgattcatatctttcttcttcttcctctacagcttcttcataaatctctctctcttctcctctcttctcaaagatcgaacctttcgatttcagtctcttcagagttctttcgttttcatcgaaacaatggcgaagaacgttgggattttggctatggatatctatttccctcccacctgtgttcaacaggtaacaaaactccaagcttttttttttttattctctctgtttattattggagctattgcatttgatactctgtttttatcagagcatctttctgttttgtgtaccgttttaattctccatttttgacgtttggtttcataaatcttcaaactttatgagattttacgaacagggctttgagaatcaatccaagaaaatctcgttagattagacacacacacgaacacttgtttcattgtctctgtttttttgttctttcttctctgtaatggcggcggagttttgtatccgatgaagacagaaaatgctcaatttttaattttcatttaagaaacaaaaggatttttattaaatttctctattctcaaactcgagatctctgcatctgattgaaatgaggactttgaaaggttgaaagggtttttttttatactgagatttatcgtataagtctcaattggaaaaactgaaaaaggtacaattttgtgaatctgatcttgttgatcattttttggttatataggaagctttggaagcacatgatggagcaagtaaagggaaatacactattggacttggccaagattgtttagctttttgcactgagcttgaagatgttatctcc

SEQ ID NO: 869 - DNA, 1809 bp, Arabidopsis thaliana
  misc_feature (1)..(1809): Ceres promoter ID no. AtSREBP
aggcatgcatcatgtcggtagtggtactctactactacgtctcactctcgtatacacattaagacacctaacatgatctcttctctacttagacaatattacaaaaagattatctactatacgtacctcaaactcacgtactcacatcaacaagtggttaagtttgacttcccggctccgcctcttgcggcggttgcatcctccccacgtgcacacccacgcctttctctaactcttccccactcttgcaacgacaagtttaatctttactcggcgagcaaatactatgccgcttgaaccggcgtaacaacacccacgatcttcctaagtgtctcaaacctcagcttatcagcttactagtatccaatctataaatgtaaacactttaacttgttatgatttatcgtaaatcatttatgaatcaagaaaaccaaatttatatgcgtctacaactctacatgaactggaacatctgattgataacacattatagttcatattttcatatttgcaagcaaaggtataagaagaggatggaacaaaatataaaaaatgaattgaatcactcgccataaaataatatacttggcacattatttatgttttttgccaaacatttggcacaatttataaatttataaattacaaagactgaagcaaaccattattccatatatacaaaaaaaacttagcatttaaatttatattatagacaatcgcaataacatcaagggtaaatataaacattatttcatattctgtcgatccaatatatatagagaaatataaaggtatattattactgtgggtcatgtcgttttaagacaattccgacataagaacagttaactgttgaactttatttatgttttggactagtgagtagtgacacctcaaaagaaaaaaatgaatacacgtgagttacgagtttcaactaattcatttaacttactgtttgacatgatagctgtaaaatacaaagcacagcaacattttcattttatgggctttaacaacattgataatccatgtcaagcgagagataacgataattgagttcatttagattcaaatttcttttaaatgagaacttttaacaatggagctctttttttttggcttcggttagatattctgattcaaattgtacacaagcatcattatggatatgcttatattaaaaaccgtgtgatggcctattagtaacaagtagtatttaccaaactttgatcaaaaaattattagtagatataaatgttttccaatgcaactaatcgttgtattggaatagttcatgatgcaaacaaaattattaacaagtctttaccaaaatttaatccaaatgtatggctaatcacaaaaggtttccaatatcagcaagtaataattaatagttgaaatgatgctaaacaaaattaactacctaatgcctagagcaatgtaaattgtctctaatcaaaactttagtgttgaccaaaatcattaaacaattataatttgtaacgtatataatcaatcatgtgattagttcaaaaaagaaaccaaaaagtcgatcatacatttatataattgttaggtaattcatggacacacatcaattaattaacattacacttttgacagtgtaaaacagacagtgttataataagtgaagagtatatgaatagggctgagctgtgcaaagacctgtctctctctcacttataattccctcttcacacattacttcttcacttatagagattctcacttacatttcccattttacccttcttcttccttcaaatccactgatgtcttgttattgaa

SEQ ID NO: 870 - DNA, 1616 bp, Arabidopsis thaliana
  misc_feature (1)..(1616): Ceres promoter ID no. AtSQS1
acgatcagttaatgaacaatgaatcctaaaatgcgagttatttaatttccatcatgtacaatgagatcttcagaagcatccgaattacttactactaaagaggaattgaaattgaactaacaaatttacacatcaattaaacccagaaactgagaaattctaccgagagttcttgaagaaaccatcccatcgccttgtgaaacttcgaaatcccaacacaatcagcacttgaatttcatgccgagaccatgcttaccacgaacgataccaggcttcaaaaacggagatatcttcgaggcatagaccttggcgattgctcttttccccagtttcctcatcctttgtctccccaccttcttactcacgctacgcggaaccaactcttcgtcaagatcatacgaatcgtcgtactcgcgatcttcttcgccgtcgtcattaacactatctccgtacgtaattccaacagaataaccagaacctccaccgagaaacatcatccgctgctgagaccatccaagatcattctcatcaacttcatcgcgaacgacatcatcgccaacatcatcatcaccatccagatccacggcgagatcaccaccgtcagcaataggaattatctcatgcggcggagaaatgacagagggtgcgacaaaggaagcgtcgtcaagagatatgacgtcatcgtcggaaagactatcgacggagaaagaatcgtcggagaactcgccatcagaaggattaacaacttcccagagatcgagatcaacttcttgatcgagaatgagaggagacatggtgataaccctagatcgctgcgccattttcgaaattgtgtgttgtttagaggttgcttctttgatttttcaagactgtttgtttttgataaccagaggaagttaccctattaatagaggcaaaccaccgagtgttatcttgtgctaattggtagttacactgttgaagatacgtatttacaaccagttatatgttgccacgtaaggattattttgccacctcagcgtcgccagaaagtttgccagtaaataaataagtggacatgtaaatttgatgtcgtacatttatgataataaaaactaaaaagataccttttcttccatttttttagaatatacctttttttcctttcaacatctataatttgatcatttctttctaattttgttaatttctgattatattaaacacattttctctgttttctgtttttttaatctaattaacacataagaaaaagggagttaaaaagaataaatgtactctccatttccatttgatgatattctttaagtttcgtggctctttttcaatttcattggctctgacattttgtttttaattaaaaaggaagaaacaaacaaaatgtgaatccttgtgagttggctcactggcaaaaaagaaagaaaaaaaattcagaagcctttgttttcatcgatgaataaattaacaaacaaaactaaaaaataggatattcgctggccgaatcgcgtcgatccacatcgcaggtgagggttcctgcaatttatccctcgtggtctctgaatctcagatcgtcgtcaacgaatcctccattttctgaatcaaaattttctggaaac

SEQ ID NO: 871 - DNA, 1000 bp, Arabidopsis thaliana
  misc_feature (1)..(1000): Ceres promoter ID no. PT0564
aacaaaatagtcccgcaggttaaaacctagtattttacaaaaatatagacaaataaaataaaaatgaactatcgtggatttagttagagaaatccatacaaaaataaattgcattgagaaactttagatgacgactaagtaatataagattttgcattgagaaagcttacatgtcaccctaatttctatcaaaagggtttctgatactaattggaaccatgtgagaaactatccatagaaatgatgatcttatctagttatcatgagctgatgactttgaatattccacagtcactaaacgcatgtttatttctcagctttatgaatctgtatgtagacacactttcgtattttcttcacttttgtgtatttgtattgcccattcctcttttaccaaccaataaaaaaagcagtcttttttttgtttggtcaagcattggcactctttgtcaatcaattacccaagggatatataataataaattggaataatgaaagtagttcatcataaggttcgtgattattaacttctacttttgtttatattcaatagattaagatgccgtgtatgataaggagagcaaaagtaatccgatagagatcacagcaatattcattacaaaatagttttcaaataaaaacacatgatcaaaaagtgactcacaaaaacacatgatacgtacgtgggatgctaatcctaaagcaacaaggccacaagggcaaaatatgtagctttcatgctttggcaaagcgaaaactctagttaagcttacctaacagaaaaaataacccccaaaaaagcgttacgttccaaacatttagacagggtacacgtgaatgactcccactttttttaaaaaaataatagtactatcaattcaaatgtgtaaacaacaaaaaaaaaaaatgtgtaagtaacgtctgtaattgatttgataagataaaaaaatcttgattaatttttctataaattgaagcctttcctctttacatttcgtta

SEQ ID NO: 872 - DNA, 1000 bp, Arabidopsis thaliana
  misc_feature (1)..(1000): Ceres promoter ID no. PT0623
aaagttattgacattttgaaacgaccgtaaatattaccaaaaaactgacggagttaggatcggccacgtagaaagggacaaagagagaacagtcacggactcggccagactaagtatgggcctgtctgaatccaaactcagctaagttccaaaagcataaagagagatgtgtaatgaaatgaacgtattctagaaacgaaagcaatgttatgctttgtttttgagccacatgtttttgggagatggagagaatcttttttacgtttttaacctaacccacttggcacttggccaaaaaagtgagaagaaactgtggcgaatgagtaggccacgccatggactttgttccttgtccttcaaaagttaaatttatgttatgcgtggggacaatctaagcaacgtggttcctttaaatatcgcagcttcctcttttacacttttggagcctacgtgttttgttttggaccggccaaatacacgagtcagtcagtttagaaataatttggatgtccaaaaatcttggagatccaaataaaataattagcatgttttagttcataagaatatgaaatgtagataaactgtccatattaatttttccatagaattggctttttatcgaggtgatgtacttaatgactttgttgattactactcgtataacaataaagaatatgatactatgtgagacttataatgaatttggtgtgtgttaattaatccagttgaaacagtttaataacaaatcagaataaaaattgtagtaagaaaatttgaacgctgatccttcaacctagatagtgaacctttcaaatactatatgattcacgtgtaatgtttttgaccgttggttatttttgtgtgaactatattaacttatcaatatcgaaaggctaaataagtaaataactaaaagaaagttcaggaaacaactcgacctaatgacctatcatttctgatcacccgtcctataaatacatacgtaagatcattcgttact

SEQ ID NO: 873 - DNA, 915 bp, Arabidopsis thaliana
  misc_feature (1)..(915): Ceres promoter ID no. YP0049
acatcaatttgcctgcttgtagggtgattcgtcaaatctattatcaggttttaaatatactcgaattgacttccaaattcttagtctctagtgtaatgattttgagaatcacttaactccaaaaatataatccacgatcccgtgttaattattgaagaatcaatcgtttttaatttctcaccaatagatgttgctcttattacttaaaacaaattgtttagacaaatgtagcaagtgtgatacttagtgggatcttaaagacgatttctcctataacagaggacaaacaggtcggtcaattacaatgtcatccctctttaccctgtctttttttttcttcttaaaacctaaccatttgattgtttctaaaggtatttcaagaatatatgatcaatctagatgaatactataccgacgatgactacacacacaaggaaatatatatatcagctttcttttcacctaaaagtggtcccggtttagaatctaattcctttatctctcattttcttctgcttcacattcccgctagtcaaatgttaataagtgcacacaacgttttctcgaagcattagaatgtcctcctcttaattaatctccttctgattagattctcaatagagtttaaatttgttaatggagagatatattgggaccctcaaggcttctaattataccacgtttggcataattctctatcgtttggggccacatctttcacacttcattaccttatcaccaaaacataaaatcaatcaacttttttttgccttattgattgtgttggatccctccaaaattaaaacttgtgttccccacaaaagcttacccaatttcacttcaatcttaacaaataggaccaccactaccacgtacggtttgcatcatacaaaccacaaactccttcttcattac

SEQ ID NO: 874 - DNA, 1000 bp, Arabidopsis thaliana
  misc_feature (1)..(1000): Ceres promoter ID no. YP0356
ttagttcattgaaacgtcaactttttacttgcaaccactttgtaggaccattaactgcaaaataagaattctctaagcttcacaaggggttcgtttggtgctataaaaacattgttttaagaactggtttactggttctataaatctataaatccaaatatgaagtatggcaataataataacatgttagcacaaaaaatactcattaaattcctacccaaaaaaaatctttatatgaaactaaaacttatatacacaataatagtgatacaaagtaggtcttgatattcaactattcgggattttctggtttcgagtaattcgtataaaaggtttaagatctattatgttcactgaaatcttaactttgttttgtttccagttttaactagtagaaattgaaagttttaaaaattgttacttacaataaaatttgaatcaatatccttaatcaaaggatcttaagactagcacaattaaaacatataacgtagaatatctgaaataactcgaaaatatctgaactaagttagtagttttaaaatataatcccggtttggaccgggcagtatgtacttcaatacttgtgggttttgacgattttggatcggattgggcgggccagccagattgatctattacaaatttcacctgtcaacgctaactccgaacttaatcaaagattttgagctaaggaaaactaatcagtgatcacccaaagaaaacattcgtgaataattgtttgctttccatggcagcaaaacaaataggacccaaataggaatgtcaaaaaaaagaaagacacgaaacgaagtagtataacgtaacacacaaaaataaactagagatattaaaaacacatgtccacacatggatacaagagcatttaaggagcagaaggcacgtagtggttagaaggtatgtgatataattaatcggcccaaatagattggtaagtagtagccgtctatatcatccatactcatcataacttcaacct

SEQ ID NO: 875 - DNA, 1000 bp, Arabidopsis thaliana
  misc_feature (1)..(1000): Ceres promoter ID no. PT0684
tagctagatttctatataaacagaagaaagttaaaaagcaaataaaaattcacaaatagaaatcgaacaaaaagctatgaaaatataaataccataaccttatggaaaaacgatgaaatgcttaacaaaaaaaactttggcaatggcatgcatgtgcctgtaacagaaggcccccataagctgttagtgatatacaacttaagcaaatgtgcactcttcacgcacttcccgcttttctaaatttcaatttatttgtctacatttttgtccaaattattgatataattctaccacgacttcccccacatgtccctccaaagagatccgtactacacagtctaccgacagcacatgcatggattttccaaaccatcttctttaaggataatccttgacatttttaatattaaaaaaataacaaaaaattcaatatataaataacatcctaaatctatgttttggtagaaaacaagttctaaagttcacatttggacagtggttagtacttggtaatcaaaatatttgtttaagaatcttgactacttacttagtctaaaccctaacgtacatggttagacatattagacacaattctattctatagcttcttaacaaacgtttagcataatccgaaattggttttaccaatatttattaccgtacgtgtgtttttttctgtaagaaaggaaaaaaagccaactcatgattcttctgatattgcatgtaatatatttgccaaataagcttacgacacaaacacaatgacactatgacagtaagatatcatttcaaaatacggatatacccccaaattggtggcaatgacaaagaaaaaaagagttcttcacagtggcacattcgtaatacatatgaactttggtggttgtttcgtaatatagatcgtacttaaaacctctaaacaccgttctctttatttgccatcttcttcattatcatcatctccatctctctctctctctctctcattttcttgaaaaag

SEQ ID NO: 876 - DNA, 1000 bp, Arabidopsis thaliana
  misc_feature (1)..(1000): Ceres promoter ID no. PT0678
aattaaatgaaactcgcccctaaattaggagggatttgggtaagtggtaacacattcactggaaacatgtgaagaaaggaggatgtcaagtagctgaaaactcagtatagtaaccaacggcttctcaccaacctttcattaataatttggtcatccctatatttttattcaacattttgtttttcaatagcttagagcaccttaatacctttcagtgtttttttataaaaaaaaacaaaaattgggattaatcatcaatccccaaatgtaacgtttacttagattatgttcatttttctatacacacaaatcatattcttttgttttaatcttcgaaaaacgagaggacattaaatacccctaaaaaaggaggggacattactaccaacgtacattaacatgtttgatagcaaacgatttattttgttcgttttgaaaaggggaaagtaatgtgtaaattatgtaaagattaataaacttttatggtatagtaacattttcgaataataagagagggaaaacactcgccattgtcggcaatttagaaccaatattagaagggtttttttagagaaaaaggacttaaaagtttagagaccttaacaacaacttatttagaaatagacatgcttaagttgacaacagcgagtttattttctatatcgaagaaaaatacgaactttttcttaattagatttcgaatgcatgcactatcgagaatcgaccgtcacaagaaaaaactaatatacatactgtacatatctatattcaatattggtggggatgggtttaatgtgtatttataattcatggataaattcacacaataaggtccatgaaactagaaggtaccaaaaataagcattaatgactctttgccacttatatatatgattctctcatagtaccattttattctcccaaacctatcttcttcttcctctcttgtctctctcgctctctctcttctacattgtttcttgaggtcaatctattaaaa

SEQ ID NO: 877 - DNA, 1823 bp, Arabidopsis thaliana
  misc_feature (1)..(1823): Ceres Promoter 21876
gtctcttaaaaaggatgaacaaacacgaaactggtggattatacaaatgtcgccttatacatatatcggttattggccaaaagagctattttaccttatggataatggtgctactatggttggagttggaggtgtagttcaggcttcaccttctggtttaagccctccaatgggtaatggtaaatttccggcaaaaggtcctttgagatcagccatgttttccaatgttgaggtcttatattccaagtatgagaaaggtaaaataaatgcgtttcctatagtggagttgctagatagtagtagatgttatgggctacgaattggtaagagagttcgattttggactagtccactcggatactttttcaattatggtggtcctggaggaatctcttgtggagtttgatatttgcgagtataatctttgaacttgtgtagattgtacccaaaaccgaaaacatatcctatataaatttcattatgagagtaaaattgtttgttttatgtatcatttctcaactgtgattgagttgactattgaaaacatatcttagataagtttcgttatgagagttaatgatgattgatgacatacacactcctttatgatggtgattcaacgttttggagaaaatttatttataatctctcataaattctccgttattagttgaataaaatcttaaatgtctcctttaaccatagcaaaccaacttaaaaatttagattttaaagttaagatggatattgtgattcaacgattaattatcgtaatgcatattgattatgtaaaataaaatctaactaccggaatttattcaataactccattgtgtgactgcatttaaatatatgttttatgtcccattaattaggctgtaatttcgatttatcaatttatatactagtattaatttaattccatagatttatcaaagccaactcatgacggctagggttttccgtcaccttttcgatcatcaagagagtttttttataaaaaaatttatacaattatacaatttcttaaccaaacaacacataattataagctatttaacatttcaaattgaaaaaaaaaatgtatgagaattttgtggatccatttttgtaattctttgttgggtaaattcacaaccaaaaaaatagaaaggcccaaaacgcgtaagggcaaattagtaaaagtagaaccacaaagagaaagcgaaaaccctagacacctcgtagctataagtaccctcgagtcgaccaggattagggtgcgctctcatatttctcacattttcgtagccgcaagactcctttcagattcttacttgcaggttagatattttctctctttagtgtctccgatcttcatcttcttatgattattgtagctgtttagggtttagattcttagttttagctctatattgactgtgattatcgcttattctttgctgttgttatactgcttttgattctctagctttagatccgtttactcgtcgatcaatattgttcctattgagtctgatgtataatcctctgattaattgatagcgtttagttttgatatcgtcttcgcatgttttttatcatgtcgatctgtatctgctctggttatagttgattctgatgtatttggttggtgatgttccttagatttgatatacctgttgtctcgtggtttgatatgatagctcaactggtgatatgtggttttgtttcagtggatctgtgtttgattatattgttgacgttttggttgttgtatggttgatggttgatgtatttttgttgattctgatgtttcgatttttgtttttgttttgacagct

SEQ ID NO: 878 - DNA, 1000 bp, Arabidopsis thaliana
  misc_feature (1)..(1000): Ceres Promoter PT0668
atagagttttactatgcttttggaatctttcttctaatgtgccaactacagagaaatacatgtattaccactaggaatcggaccatatcatagatatcaggattagataactagttctcgtcgctatcacttcgcattaagttctagtaattgttaaagattctaattttttactaaacaaaaactaaatcaacatcaaatatgcaaagtgtgtgttgtccacacaagtgactcaaagtatacgcaggtgggattggaccatattattgcaaatcgtttccgaaccactcatatttctttttttctctcctttttttatccggagaattatggaaccacttcatttcaacttcaaaactaattttttggttcagtgatcaaatacaaaaaaaaaaaaaaagttatagatattaaatagaaaactattccaatcttaaaaatacaaatgaaaccataattttaatttatacaaaactatttaattagctaagggttgtcttaacgtttagaaaataaaaaattatgattgtctgtttaaaattacaatgaatgaataaaaaaaatatgcaatgaatgaaagaataaattttgtacatccgatagaatgagaaaatgaattttgtacaaaccactcaagaattcaaaacaattgtcaaagttttcttctcagccgtgtgtcctcctctcctagccgccacatctcacacactaatgctaaccacgcgatgtaaccgtaagcgctgagtttttgcatttcagatttcacttccaccaaacaaaactcgccacgtcatcaatacgaatcattccgtataaacgtctagattctttacagcctacaatgttctcttctttggtcggccattatttaacgctttgaacctaaatctagcccagccaacgaagaagacgaagcaaatccaaaccaaagttctccattttcgtagcttctttaagctttttcagtatcatagagacacttttttttttttgattagaa

SEQ ID NO: 879 - DNA, 1000 bp, Arabidopsis thaliana
  misc_feature (1)..(1000): Ceres Promoter PT0535
ttagtgaaattatgacattaagtaaggttttcttagttagctaatgtatggctattcaattgttatgttaggctattttagttagtatatgaatttaggcagtctatgcaaatgatttcgttttcattttttcatatgtaaacatcaagatcaagtaacgccattcgagttgatattttttttttaaattagtgtgtgtaaattttggaccgcttatttgagtttgctaatgaagttgcatatatattacgttaaaccataggcaaactaatttgaaacatccgattcgatttcctgtaatttttcttggttaattgaccaaaatcaagatcttcagaaataaaataaaagacgaaagaaagctgtcgcaaagcagattgtgttaaaaaaaagtggattgggctcaaacgcaacttgtccagcccgtgacaattaccctatacgcaagtaagagtaacgtatcactggcaaaagttggtattagttacgatatctttgtcatgggggcatgcatgggcatggcttaagagttaagccttaagaagagtcccacactcgtgactctcatgatcacttgttgtttcttacgggcaaatacatttaactttattcttcatttattcacctatattcttttggataataacttttctctatataaaataacaaacatcgtacgtttcatttatttacaacaagcgatgagaattaaaaggagaccttaattgatgatactcttcttttctctcggttacaacgggattattacagataatgataatctatatggatgctgacgtggaaaaacaaaatttggtgaaacacgtcaattaagcacgacttttccatggctagtggctaagatcgtttcatcacatggctatatcatataatacttggatgaattcaaaataaacgactgagaaaatgtccacgtcacggcgcaccgctttggacttaagtctcctataataaatacaacaccaaacattgcattcca

SEQ ID NO: 880 - DNA, 999 bp, Arabidopsis thaliana
  misc_feature (1)..(999): Ceres Promoter PT0585
tgaagtcatttaatatgagtttgacattaggtaaacctaatctatgagattatagaatgtagcaaaactatcaatgtttcttttccaaaatattttgtggtttttctttttggttcattatgttttgttatttgtgaattattttaatatgaagtaattatattgattttatatgatatacatattattttgatataaaatttaacacttatccattaaaatagcatgggcataatcaaaatcgggactattacgatgaaaaagatagttaaattgtatgataaaataaaatgtgtaagattaaaattttgggttttagaaaattactaaacaaaatatagacaaagtatgttgactattatttaaaatttaaatatcatcaataagatatagttaaagtcattaagtgtatagcaaaatgaaaattctaagattaaaattcgattaaaattttttttactaaattaaatatttaaaaatagggattatcatttactatttacaattctaatatcatgggtaaaaattgataactttttttaaacccgcctatctaggtgggcctaacctagtttactaattactatatgattaacttattaccacttttacttcttcttttttggtcaaattactttattgttttttataaagtcaaattactctttgcattgtaaataatagtagtaactaaaatcttaaaacaaaatattcaacctttcccattattggaatggtaatgtcttcaacaccattgaccaacgttaaggaatgtcttttaatatttttggaacctaaatgctaatactgtataccacaatcacttatgagtattgaagttgagatagaggaggtacaaggagaccttatctgcagaagacaaaaagccatttttagcaaaactaaagaaagaaaaaagattgaaacacaaatatgcgccactcgtagtccacccctatctctttggcaaaagccacttcactctttttccctttttat

SEQ ID NO: 881 - DNA, 1000 bp, Arabidopsis thaliana
  misc_feature (1)..(1000): Ceres Promoter PT0613
ttaatactaacattgtagaaagccacaaaaaagaaattgaaatgtgagtagatgctgagtcagaggtttggtcaatacacaacagctaattgagataatattatacacgtcacgatgacttgttttttctcctcccaacttgttaatttctttattcttaaaattaaaccatcgcaaaaacagaagaacacagctgtttttctcgactcccaatttctattttgctgctaaggacatttcatttcattatttcccaattcaggactccttagattttcctaaatttgttttcctaacttgctctctctcattctaacattttctcatttttttagattatcttgtactttttagtagattattttatcaggttttacaaacatacattgacattctaaaaagggcttctaaaaattcagtgtggaatgctgatatactaaaaaaaggtcatgcaaaattatctacgatttatctaaaattagataatttgccatatataactattaactaataatcgatcctttgattttttgtttagataaaacgaaacagctatatcttttttttttgttatcggattttaatcgaataaaagctgaaaaataacagttatatcttcttcttttttaactaatgaaacagttatatcttaaacaaacaacagaaacagtaaaatattaatgcaaatccgcgtcaagagataaattttaacaaactaataacaattgagataagattagcgcaaaagaaactctaattttagagcgtgtaaacacaaacacgtcttgaaagtaaacgtgaattacacgcttctaaaacgagcgtgagttttggttataacgaagatacggtgaagtgtgacacctttctacgttaatttcagtttgaggacacaactcaagttatgtttgatatctaaggacttgcactgtctccaaatctgcaggaaggactttttgattggatcaatataaataccatctccattctcgtctccttc

SEQ ID NO: 882 - DNA, 351 bp, Arabidopsis thaliana
  misc_feature (1)..(351): Ceres Promoter PT0625
gatcatgatcagtttcaactcgctgtgcccacgtgtcgagagatcggcacgtgcctgagctctcagccgctcataaatacacttgtttagtagcaacagtatactatagtagtcctctcctgtttggcttttagcttgcatcgatggatggatggatggatcgcatgagagggcttcgcgaaggtacggaaccttacacaacgcgtgtcctttctacgtggccatcgtgtaggcgtctcgccatgctacgtgtcccggaggatgtctcgatgccaacccttataaatactgttccattccaatcccatcgccacagccagtgcaaatctgatcgatcaagataatcgagca

SEQ ID NO: 883 - DNA, 1022 bp, Arabidopsis thaliana
  misc_feature (1)..(1022): Ceres Promoter PT0633
cccgatcggccttaatctgagtcctaaaaactgttatacttaacagttaacgcatgatttgatggaggagccatagatgcaattcaatcaaactgaaatttctgcaagaatctcaaacacggagatctcaaagtttgaaagaaaatttatttcttcgactcaaaacaaacttacgaaatttaggtagaacttatatacattatattgtaattttttgtaacaaaatgtttttattattattatagaattttactggttaaattaaaaatgaatagaaaaggtgaattaagaggagagaggaggtaaacattttcttctattttttcatattttcaggataaattattgtaaaagtttacaagatttccatttgactagtgtaaatgaggaatattctctagtaagatcattatttcatctacttcttttatcttctaccagtagaggaataaacaatatttagctcctttgtaaatacaaattaattttcgttcttgacatcattcaattttaattttacgtataaaataaaagatcatacctattagaacgattaaggagaaatacaattcgaatgagaaggatgtgccgtttgttataataaacagccacacgacgtaaacgtaaaatgaccacatgatgggccaatagacatggaccgactactaataatagtaagttacattttaggatggaataaatatcataccgacatcagtttgaaagaaaagggaaaaaaagaaaaaataaataaaagatatactaccgacatgagttccaaaaagcaaaaaaaaagatcaagccgacacagacacgcgtagagagcaaaatgactttgacgtcacaccacgaaaacagacgcttcatacgtgtccctttatctctctcagtctctctataaacttagtgagaccctcctctgttttactcacaaatatgcaaactagaaaacaatcatcaggaataaagggtttgattacttctattggaaagaaaaaaatctttggaaaaggcctgcaggg

SEQ ID NO: 884 - DNA, 1000 bp, Arabidopsis thaliana
  misc_feature (1)..(1000): Ceres Promoter PT0650
catacttaattctaaaaaaacaacacttatagtttataagcagctcttatgataaaaatctttctgagttatagctctgttaaacttgtattcaccccaaaaacggatgtttcatttcttattttttacttggagtattttattgtaatttgtaaaaaaaaatgtaaagtgggggatatcatgaaaaacaacgtcactttgtttggtcacaatatacatttgataaaataatggtcgtcgcgtgatttagttgatttttgttttatcaaccacgtgtttcacttgatgagtagtttatatagttaacatgattcggccacttcagatttgggtttgcccacatatgacataccgacatagaaggttaaatccacgtgggaaatgccaatattcaatgtttggttttcaaaagagaatcatttctttatatgatctcaaaagtatggaattgaaatgactaatgagcacatgcaattggtgctatcttaaaaaccgaacgtctttgaatttaatttgtttttcaccaaaggtacctaatgaaaccctttcattaaaaaataaaggtaacaaacaaaattttgtattggaaaaaacattttttggaatatataatttggtaatagaattatgagcaaaaaagaaaaagaaaagaaagaataatgagcataataaagcctttacagtattactaattgggccgagcagttttgggctcttgatcatgtctagtaatcttaaacagacgataaagttaactgcaatttagttggttcaggtgagctaccaaatccaaaaatacgcagattaggttcaccgtaccggaacaaaccggatttatcaaaatccttaagttatacgaaatcacgcttttccttcgatttctccgctcttctccactcttcttctctgttctatcgcagacatttttgtttatatgcatacataataataatacactcttgtcaggatttttgattctctctttggttttctcggaaaa

SEQ ID NO: 885 - DNA, 998 bp, Arabidopsis thaliana
  misc_feature (1)..(998): Ceres Promoter PT0660
caagtcaagttccaatattctaaggagaaataatagtatactaaacatacattagagaggttaaacttctttttggatttaagtgtgtatgcataggctatttattcttaagtataactattaactgtagctagatttatacaagaaatacataaaactttatgcatgtgaggtagccatgaatatacgtacatgttgcaatcgattatacatgttgtatttggatttctctatacatgttttaacttgtcattctctaagtatatacataccattaatactgtgggcatgagtttatgataagacttttcttttggagaccagttttgttttcctttccacctatatttgtctataggcttcacggtacactagtttacaagtgtttttatatgttctaaataaaattgagattttccggaacggtatgatctgtttgcaaataaggacgtatatataacagtatcaaatatatttgttgttataaggcaataatatattttctgagatattgcgtgttacaaaaaagaaatatttgttaagaaaaaaaaagatggtcgaaaaaggggagtaggtgggggcggtcggcttttgattagtaataaaagaaaccacacgagtgacctaccgattcgactcaacgagtctaccgagctaacacagattcaactcgctcgagcttcgttttatgacaagttggtttttttttttttttttaattttttcatcttcttgggtttggttgggtcactcttcaggtcaggtgtgtaaaaaagaaagaaagaaaagagagattgttgtgttgtaacccctttgactaaaatctaatgaacttttttaacacaacaaaactccttcagatctgaaagggttcttcttctctcttagtctcttcgtccttttattctccgtcgtcgtttcatgatctgactctctggtcttctcttcttcttcttcttcttctattttttcttacttcgtcactgttgtgtctgaac

SEQ ID NO: 886 - DNA, 1000 bp, Arabidopsis thaliana
  misc_feature (1)..(1000): Ceres Promoter PT0665
aaaaaggatgggtaatgggacctattttccccaacatcccacatgcacacttccctctccattctctcacatttatttctttcattctaatttatccattccgtgtgtaacatattcactaataatctcatctcactaactcattcattgattgtgatatgtttatctagaattagtgttttaacactgtgtctacatatgatttccttttcattgtatgtgaacatgttaactcactaatcattttgtattttcgagttaacatgagtctccacttcggtagactaaagtaaagataggtttgagtataataaagtttaaaatttgctttaaaatcaatatttataaataagtttttatcataagtgatttttgtatgttatattggaccttgtataaacagactacagaagaaaattatttatgagaacttgtaatgttagagtggacctcgtataaactaattatgtgggcttttaccataaactatttatgaaaattattatggcccacaccactataactaaagcccacatatttagcagcccagtttcattgtaagagacatgttcgctctggaactagaattttctggtttttgggtatttgttttcttatgtgtagagaaatgatggtaacgattaaatgttgtgtattacaatttacaatggtaagacgattaatatatttacacacaattttgttgttgctgtaacacgttagtgtgtgtgatgatagaatttcataaagctttaactacgaggggcaaaatgttaattctaaatagttgacagcagaaaaagatatgtatacataatataaggattaaaacgtaaataataataaataaggcgagttaaattaaaaccctgttaaaaccctagcttgaaacacatgtataaaaacacttgcgagcgcagcttcatcgccatcgccattctctctctcatcaaaagcttttctccttgattttcgcattctttagagtcttaacgcaaag

SEQ ID NO: 887 - DNA, 999 bp, Arabidopsis thaliana
  misc_feature (1)..(999): Ceres Promoter PT0672
cagccgtaaatcctccataaatttattttgcaagttttgctcattatataatgagcggaatttatgatataatcgtttgtaataatgttatgttttgatcaaaatttgaaattaaaagtaggtgagaacttgttatacagtgtagataaggtggatcttgaatataaaaataaaatttataagatgtatttaaagcagaaaagcataaaactttagataaaataatgtaaaaatgtgttagcatcaatgttgggatattggccgacccgaacttaatcaatgtcggaagccattacttctctcccaaaagacctttttccttcggagaactaggaacttcctcactacctttcgcttaacgtgaaagccataaatttcatatattcataaaaatcagaaaatctaaaactgtttagtatcacctgtttttggtatagactattggttttgtgttacttcctaaactatatgatttcgtacttcattggatcttatagagatgaatattcgtaaaaagataagttatctggtgaaacgttacttcagtcatgttgggtctagatttacatactactatgaaacattttaagataataattatcctagccaactatatgttctatattatgggccaagaagatatagaactaaaagttcagaatttaacgatataaattactagtatattctaatacttgaatgattactgttttagttgtttagaataaatagtagcgtgttggttaagataccatctatccacatctatatttgtgtgggttacataaaatgtacataatattatatacatatatatgtatatttttgataaagccatatattactccttgacctctgcccccatttccttttactataaataggaatactcatgatcctctaattcagcaatcaacaccaacgaacacaaccttttccaaagccaataataaaagaacaaaagcttttagtttcatcaaagacgaagctgccttagaa

SEQ ID NO: 888 - DNA, 1000 bp, Arabidopsis thaliana
  misc_feature (1)..(1000): Ceres Promoter PT0676
aagatagtacagtttcagtgttttgagaaaaaaagctgaactaaaactaaaatgtttaaggacacaatatttagtttcaattagataattcaacagtttgaacaattttttttttttttttttgaagtcatttatttatacaatgttttaaaacgcattaagcatttaggcagccgacaaacgcctattgtctaactgtaaataggcgcttccacttaggttcatattgcatatttactatatgtgtatagtgacaaaaaccaatatttctcttattttggatgaaggtatagtagttgttaaatgttcaatataattaagcattaatgacaaataaaataaaattaatttagttgataaaaagataatcttataaaaagatcgatgaatagatataatggtttactgaattctatagctcttaccttgcacgactatgtcccaaggagaggaagtaccttaactataattctgaacataattttgtctatcttggtgagtattatatgacctaaaccctttaataagaaaaagtataatactggcgtaacgtaataaattaacacaatcataagttgttgacaagcaaaaaaacatacataatttgtttaatgagatatattagttatagttcttatgtcaaagtacaattatgcctaccaaaattaattaatgatttcaacaggaagtctgagatgatgggccgacgtgtagttacgtttcttgaattgtgagagatggtatttattatactgaagaaaacattatttactaaataaattttcatttcacatcttctgtaatcaatgcgggtagatgaagaagttgttaatacgatggccaaccatatggatctcttttttggcgtttctatatatagtaacctcgactccaaaggcattacgtgactcaataaaatcaagtcttttgtttccttttatccaaaaaaaaaaaaaagtcttgtgtttctcttaggttggttgagaatcatttcatttca

SEQ ID NO: 889 - DNA, 998 bp, Arabidopsis thaliana
  misc_feature (1)..(998): Ceres Promoter PT0678
aattaaatgaaaccgcccctaaattaggagggatttgggtaagtggtaacacattcactggaaacatgtgaagaaaggaggatgtcaagtagctgaaaactcagtatagtaaccaacggcttctcaccaacctttcattaataatttggtcatccctatatttttattcaacattttgtttttcaatagcttagagcaccttaatacctttcagtgtttttttataaaaaaaacaaaaattgggattaatcatcaatccccaaatgtaacgtttacttagattatgttcatttttctatacacacaaatcatattcttttgttttaatcttcgaaaaacgagaggacattaaatacccctaaaaaaggaggggacattactaccaacgtacattaacatgtttgatagcaaacgatttattttgttcgttttgaaaaggggaaagtaatgtgtaaattatgtaaagattaataaacttttatggtatagtaacattttcgaataataagagagggaaaacactcgccattgtcggcaatttagaaccaatattagaagggtttttttagagaaaaaggacttaaaagtttagagaccttaacaacaacttatttagaaatagacatgcttaagttgacaacagcgagtttattttctatatcgaagaaaaatacgaactttttcttaattagatttcgaatgcatgcactatcgagaatcgaccgtcacaagaaaaaactaatatacatactgtacatatctatattcaatattggtggggatgggtttaatgtgtatttataattcatggataaattcacacaataaggtccatgaaactagaaggtaccaaaaataagcattaatgactctttgccacttatatatatgattctctcatagtaccattttattctcccaaacctatcttcttcttcctctcttgtctctctcgctctctctcttctacattgtttcttgaggtcaatctattaaaa

SEQ ID NO: 890 - DNA, 1000 bp, Arabidopsis thaliana
  misc_feature (1)..(1000): Ceres Promoter PT0683
gattgaatgatgagtgtgcacccttgtattactaataaaaaatttagcaacagttataagctaacgtcatccatgagtcattcattagattcactatttgcgttctcaaaaatcgaattgttaaaatttgagaagctctaatatacgagtcaatgagatgtggcaaaagcatgtccttgaccataaaatttcgaggggtcaactcattagataaggacaagaatcaaccaattgaaggcgtcttctataacaagtttctttattactaatattaaagtccaatggggtgagggggagaagaacttaaataaaaggaaataattggtaagtgaataaaatctaaatacgatactagatgattgatttgtgctagtgcatggtattagatcagatatgtgttactattcgaattcaaattggcatattccatgttgttgataagaaaattgtagaagtgtaaaagctgagttactatattcaaactagtggtttacataaagtgagacaacaactgtttcacaaaaatgactataaaatagtaagtagtattaggtcaattgattttaaaattttaatcaaattcaaatttgtgatataatcaaatttgtttatagaaaatgttaagaaatcaattttggcagaactaattcagtgagaaacaatcatttacaaaaacaattttaacattatttaacagtaagatttgacatttaacccgttcgtgtgaacccatcatatctaacatggctctacccatgacgcctccatgccatggacaattttgacagatcagaagttctgaacgtggacgaggtaagaacaccatgatgatacgattggagttagttatgtcgccaccgacatcactgccaatctcattaataaaagtggtactaaatctctaatctctattaactataaatataacaaagaaccaaaagaaagtttcttatctctcttatctttcataatttccaagaaacacaaaccttttctacta

SEQ ID NO: 891 - DNA, 1000 bp, Arabidopsis thaliana
  misc_feature (1)..(1000): Ceres Promoter PT0688
acgttcagaggcatcgcttttgtacaaattgaagcgggtttgttcaatatttaaaataacacaggaaacattcaaatgtattattgatgttgcttaggtttgtgaaatgatatgaaccatatcgtatatattactagatttttcttatatgttttaagggtagtggggctgacctatcattctgtttggcattaccaatcagactatcagagtattcaccattcaggattccataactagaaaaagaaggggtttacattttctcatactgtataattttctactatcagagattttatcgattacattaatctcatagtgattattctgatttataaaaaagttgacaaaataattaaaaccagtattttataacaagattgtctctctcccatggccattattttgacctctgacttatttaaatcttaattaacagcataatactgtattaagcgtatttaaatgaaacaaaataaaagaaaaaaagaacaaaacgaaagagtggaccacatgcgtgtcaagaaaggccggtcgttaccgttaaggtgtgtcgaactgtgattgggccacgttaacggcgtatccaaaagaaagaaagggcacgtgtatagatctaggaaaaaagaaagaatggacggtttagattgtatctaggtaccaggaaatggaacgtcacaccaaacggtacgtgtcggatcctgcccgttgatgctgacggtcagcaacttccccttattcatgcccccctgcccgttaattacgtgtaacccttccatgcgaaaatcaaacccttttttttttttgcgttcttcttcaacttttctttttaaatcaaaccttttctttttaaaatcacattgcatttcctaacgctcaacaaaatctctctctactaatatctctctctctctctctctattgttgaagaagactcataatcggagattgtttgtttttggtttgctctgtaaattggagaagttttgttagagatcaa

SEQ ID NO: 892 - DNA, 1000 bp, Arabidopsis thaliana
  misc_feature (1)..(1000): Ceres Promoter PT0695
aacattttctttaacttactcttaaattttaatagtaagttgatgcatgttatgttgatccgtcttgatcacaaatattgttttatggacgaattctttgacagtaaatggctatagtgactcagcttggagcatcccgatatgaaaacaaagtgcagtattgtgtcgtggtcatcactaacgcactttcctagaactatcgcgcgtgtttgacctatgcaacacaccagatgtcatgaacgtatacttaaatagaaacaatgatatagacaattggctatattctgtcatggaacgcaaaccggataacatgtctattagattcatcggacttgatcatggttatgtcttaatagacgaattctttgttaacgattggttaaaacggctcacgttagagcatcctactatgacttcaaaattgataaatattacatggaaatcactttaattttagttagaaggtagttaatttagatattcttatttaataaattaaaaaatagaagaaaaaaagatgagaagagtttttgtttataaaataagaaatatcttttattgtaattttaaaattaaacaaatttaatttatattaaaattatctttgttttattgttaaggcaataattatttttttggtgggaattgttaaaacaataattagtatactgttaagtggtcctttaataataagataacgtgatttaaaaaagaacgagacaggctaatatagtagagaggaaaaaatacaatttaggcccaataaagcccaatatagagttgtgctcaaacacaggtcttcgccagatttcctatgacgccgtgtgtcaatcatgacgccaagtgtcattcaagaccgtcacgtggcgttgtttctacacataggcgatccatacaaatcagtaacaaacacgaaaagagcattcatatgtacgaaagtagaaaagaagagactctttgtgataaaactaagtaagaaatagcataaaagtaaaaggga

SEQ ID NO: 893 - DNA, 1000 bp, Arabidopsis thaliana
  misc_feature (1)..(1000): Ceres Promoter PT0708
gtttccaaaactagtattctttatttgctctattcattatatttttatatttgtaacgtcccgaccgtctttattaggtttcgacaatcacttctcggaaggtcgtccatcctgaaattactctatcctaaacatgtttaactataaaattctctcgaaacttttgtaacgtatataaccacataaattctcttaaacttatttgcatacaccattatatttctgaaatcgatatgttacaatattatttaatatttagattacttttactgaatcgaattaaatatcaaatcgaaacaaatctaatctaccaaaaataattttgttataaacatttcttgcctagttctacctcatatacattttagttaaagaaagaaatcacaacaattcccataattcaataattaaatccacaaaatcttggagtaagtaagagaaataaaaagatagtatcttaacataaacaattcaaagatgctctctcacacaattcacacacacttacaaaacaaaagacagaaacaatgttttcattcaaatcaaaagaagttataacactagtacaaaaaaagctcaaattctaatagtaactctttttatttcccaattacccaaagattctctctcacttcacaaaactagctttgagagtcgtgttccacaaaatccattaaagctgaaacggttttgctcaccattcaaacaaatacaaaattgcaaaaccccaaattataacaaaataatataaaaattaaaccgctaaaaagagtgaaccaacaaaaatcgccgaatgtgtgtgtaatgagaaaaccgacccatcatcccaatcatctcttcccgtgtcactctcttcctctcccacgtttcttctctcttccctttatgggttttaacttctccttcttcttcttcttcaatcttcagttttcaaattcaacaacaattcacattttgatttcttcatcatctctctctctctcgcttctctctcaaatcg

SEQ ID NO: 894 - DNA, 1000 bp, Arabidopsis thaliana
  misc_feature (1)..(1000): Ceres Promoter PT0710
tagtgcgcgtggggagagggaatggtgaaaccttagtggttaagttatgaggaaaatgataaaaggataaaacaatcaaatgcagcttgaaacggccataacataaagtaccttatggtggtgcgaatatttttgtgtttctttcactcttttattgctgaaagctacgacacttgtcttaatatattgtttccgcaagtcacatgatctactttttatttaacgtctagaaacgccgagatatatgatgattagtatatcacgtctatgcaaattgttagttcgtgtttggccaaaagatatcgagacatgtctgaagaaccgagtctggttttgagatatttcttcaagcattactatacaatagaaaaaggagacacgcgaatatgataatagcaaaaggcataaaaaggcgaaaattaaagaaaaacgtaaagtgatttggcctcaatcaacgggaacgtatcttaattttagaggttcttcttttacttttgagacgagagagtttgcgtctttgcgagctgctttggttgactaaacattatcatattgaaaaccaaaatacaacggaggaatatttgtcacagtttcactttcacattgtttccttaacgtttaatcaaccttgttcaaaatttctatagttgtaatcatcattgtttacaaaattttcgttcaaagatgattttaaataaaattgtgaaagaaaaccttttctgaaataaggattggatgatagtgttaaaagaaaaatatgaactgaggcaaaaagaggagtggtccccggaagattgtgaaatgtgtcatctaaaccagccagacgtagtcacgtgttctctctagctttatgaacttccttagccagcaccatcattgtgattgtagtatatatgtaaccctaccttcatctctcccattttccattctccatatagactcctttacaatatacaaaacctatccaaaagcgaagaagccaagcaaacatattataaaa

SEQ ID NO: 895 - DNA, 1002 bp, Arabidopsis thaliana
  misc_feature (1)..(1002): Ceres Promoter PT0723
gtcatatcttatcaacacgtcaacgatcaaaacctttagcctattaaattcaacggcttagatcaaaacgaaactaggtgggtcccacttttaatatcgtggctgcataacatttcctcgataactgaagccgttgtggtctttctcagaatctggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgttattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttrcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaa

SEQ ID NO: 896 - DNA, 1001 bp, Arabidopsis thaliana
  misc_feature (1)..(1001): Ceres Promoter PT0740
tgtggccactaaagatttacccttaaccgggcccatataagcccacgtcaagtggcgcttatacgctctccgtaagagagccaacatttggtatgtaatgttgcaaattattcttcaagacaataaattcaaatataattcaatattgtccaaatatagtgatgtacttcagttgtgcacatagaaactccactaaaccaacttttagatagatgcattcacaaattttcaacaatgtcgcgaaagtctaatccatcaccagattctaacattttaattattatatttaactatacatactctaatcagcatgagtcaaacgtgtacaatagcccaagcatataataagaccaaagtcaaactcaaataaatgtctccaaactcaaaacttgaaaaagacctaattattacatggtagatatgactttgtcgacaagtaaaccaactaatcctcgaagctaccttctcttcccagttattatgtgtgatcgatttataaatctcttcttctaataacacctatatttttcttatgatgtgaataaatataaaacttttaactttaaaacatatttatccgaaatattgcacttagatttcaaatagataaataatagtactatctaactgatattgaaaagacctaacacggaaaacagttttataaaaaatcccaaatgtgggtaattatcttgatttcttgggggaaacagaaaatggattaagattaatcggagtcgtgtcaagcagctcgttaataactgtagcaagttgactgagtaagcatcaacgtgtcatctccgtaaagcccattatttctagtctcgccgcgtcttctcttccacgtagcacttcactttttctctccttttgtttcctttggaacacaaacgtttctatttataggaataattacgtcgtccgtatctgtgtcggaacatagatccaaattaaaagcgacttacttaattacatatcgttcgtgtttttttcttcaaaaa

SEQ ID NO: 897 - DNA, 1024 bp, Arabidopsis thaliana
  misc_feature (1)..(1024): Ceres Promoter PT0743
tcgattggcccgatcggccccaaaatcaagctgagccgcttcaaacttcagcttttgaaatcacccccaaactcatgtcctcttatcattataactaaaggatctttcattttatttaactcatcgtcttgcactacccaacccaaaggttccaactatacccgaagctttctaaaggtccaaagactttttttttcgagccagactattcaagccaagaaaagccaaaccccacaagccagtacttttcaattccatattataaacttatctgtcttgttttagtcccactaaaaacaacagaatttaatttaggttgagctaaaacccttgacaaaagtgtatagtcgtcgattcagtagcacactcatcactcatcagatttgatagttgacctaaagtatgactactccatttcaactaacaaatgaaaataaaagagacctaagggttagaggattgaaactatactctcaagtcttttatcactaggctactaccagctagttaacttgatggatttaagcaagaaaacgtagaatttatattcgagcagattgtttagctaaaaaagcttgggtttgaaattgccttttctcccatataagcacgtcggttcctaaataactctttctagcggagagtgtctttccaataatttaataaaaatggtgtttgtatatcaaaaaaaaaagaaaaaagaaactgatcgagatagaacgtttgcagttttataaacaatttaaaaaacaaaaaaaattaaactcaatgtattttttattaattcacaaacaataataaatcataggatcgaatatttacacggtatcaaaacctactcgccgctactatataaaaattgaagtcaaatatcaaccgcaattattaaaccagcaagacaataattcataaacttaatataaacataaataaattaatgttacacaacgatatatggtgagggttattactatcttcttcctctcaaaacacatctcctaaccttaagctttagacggcctgc

SEQ ID NO: 898 - DNA, 1000 bp, Arabidopsis thaliana
  misc_feature (1)..(1000): Ceres Promoter PT0758
agctagccacatcagtgaccaaaaaagataattaacaaaccaaataaaataacaaattttgatcatttggaataaaatttataaaaggaacgaaagcgccttctcacgggtcccatccattgaaatatattctctctttttgctctatataataataacgcgtactaatttgtagtatatattattacaaagtcgatatttgattgttttgtgaacgttgatatattaattttcttggatgatgacaaaaaaagtcatagaaagtaacgtgtgaacatagcattaacaaaatacaaacataatatataaccaaatatatgaaaataggataaaatctcattgaatagatcttcttctattcaaatatataaatatttgtttgtctataaaattaacagagcattcacattatctaaaataatagtaaaatcaaaataaaactaaataaaaataactctggttttataacgattgattttaaatattagtttttgttgtaaagagatcattatatatgtctgtaatatttttatactgagttacatgatatttagttattatagcgtaattaactaagataagaaattaactaaagtgatattctgattattattatttttgttaggacacgtacgtggaaaaactaaacactataggttacaaaacggtataataaactcaccattactggaaaatgtttgcatttgactcaataagtaacttattataagttactgatataatgcatagttttgaaattcttaaataaattattttggtttcgcatgaaaatatgaaaggagagaaatttattattgtcacttatatatatatacatcgtaatcattttttcgtgaataattctctctcccattccattatttctcagtatctctctttctttcccttactttattgttgcttttaaaccttcaatttgctcataaaccaaatatataatatcaaaacaaacaaacaaaaaatcagaattcccctaata

SEQ ID NO: 899 - DNA, 921 bp, Arabidopsis thaliana
  misc_feature (1)..(921): Ceres Promoter PT0829
aaagttttgaattattgggaatcaatttcgaagttttgtaattctttgggggctaataggatattttattttcttggtttcgtctattgttgtttttctatttatggttgggcttttagaactctggacaggcccatgtcatatgttttcccttctccttatatttttcatttttcattttgttaaattaatgcataatatccaaaaacaatttaaatttttgaaggaaccctttagttacggctccgaagctttcacaagtgagaatgtgagatcaaagaaggcaaatggaggattttaaaagttaaaatcatcttttatctgcaaaagttgacaatttttttgtatcaaatctaaatcatcaaactctcttaaactacaagagcataacaacctctatgtaatccatgaaataatctgcttgaaggacataacataaatcattatggctagagtgactaacttcaatcaaatcctcttaactctagctcccttacaatggtatcgtaaaacattatgcattagggattgttgtcctaggaaaataaaataaaaatccccacagaccaactaccattttaacttaaaaataagcttcgtccgcgacgaattgttttccatcctaaaaatagaatggtgtaatctgctaatggtttagttccattaacttgcaagttctattgaaagcctaaatgtcaataaagatattaaaattcggagtcaaaagacaaatgaatcaaaagcaacaagacaagtcagctccattcttcactacccatcttttacaataaatcatctctcttttcacaaatttcaaactactctcattgccctttagctttgttatagagccaacactacagagagactcacacacttgtttcaataattaaatctgaatttggctcttcttataaacta

SEQ ID NO: 900 - DNA, 763 bp, Arabidopsis thaliana
  misc_feature (1)..(763): Ceres Promoter PT0837
aactacaagggagacataatatcaccatctggttcctgttatcatctgaagatttcttgttttaccttccagtgataaaatgatccttataatacatatagatatattaaattgctgtattttaagattatagatatataaggtacatgagagtgtttatttaaaaaaattcacttggaattcatgttttgtgatacgttagattggaatccatttgggaaaagaagaatcatctgttcttatgtctcaaattttgacttcattcacttttcttcttgtcttttaagaaagcttccacaatctaactgttcgatgtgaaaactgagattcgagtaagaaaatgtgaactgtgttatactgttttttaattagataatttagattgcactcagataaattaataacattcctcgaatacttttatgtgattggatatattaggtatatctgccaaccaaccaataaactgctatgtttaaacaaattaaataaattagtatatgtttactcaagaataaagaagatagaaaagaaaattctatatgagctaaatttgctggaggaggcatcggacgtgggtaccagacctttccaagcacacgagtagtgcttagccatgtcatgctaacatacaccatttggttcatacaaaatccaaatcaaaatctatttttaaaatcttttgcacacgtctttgaaaaacacctctcatactatagctacggaagcttcaatttcaaggtttgtctaaaagctaacgatt

SEQ ID NO: 901 - DNA, 751 bp, Arabidopsis thaliana
  misc_feature (1)..(751): Ceres Promoter PT0838
atactggtatgcttaaggttgaagccaagatctctgtcttacccaagtaaccactttctattagaagggatcaacactaagaatatggagatttaagcctaagggctaaggcggttctcaacaatacatgatgtgaatacaatcacagacgatttactgaggtttgttgataagatcttgatcagtctctgcatcatctgttcaacaatctcaatctttgactgtttgctttcggagccataaacagaggaatcccttattccctgttataggagcaatacaccaagtattatttccatggctgaaattctcttatggaaacctaattgttccattgaagctgtaaaatcgaatctggtgaatattctcgagcaaagccgcatgctaattatgtcaattcagaagagtttgattaggagactcgaagcgagtttgatgatctttcttgatgttcaactccgattgtaagggtataattgacttttcatgtattacggctccaccacctgacactaaggcactctttgtccatctcgttggtatcatcggattcggatggtaaaaataaaaagagcagaggaaacttgttactcatgcaagcttctcaggtgccacgtcactccattacgtgtcatcttcacacaccatctcgctcaaaaccgatctcatttttcaaaccttaaaggcagaagcaactgattaagttaacactcttgagaagctctcgattaagcttgaacttggaggatca

SEQ ID NO: 902 - DNA, 669 bp, Arabidopsis thaliana
  misc_feature (1)..(669): Ceres Promoter PT0848
tctctttaaatcagttaactaaccgtttatatatttacgataaggtttgaagagattattgataaaataatacatttcataatcccgcgttcaaccgtttaaagtaacatttaagttgactatatctaattttttttccattaaatatggagctggtaaactttatcaacttctaaaaagtgtaacaacaaaaattaggtcaatcacaattctgttttttttattattttggattgacttccaattgcaaatagtcttagtgatcaccattatcatacatatatacatcaagtaggtttcatcatgatataccacaaagtatttgacaagccatatggttttggatcaaaaagtcggtccaaaattaatgttttatgtgcaagaaccgacccattgtacacacgtgttaacatcttcaagactttcatctctatttttcttttggtcattaagatacccattgatccgaatctgttacattcccacctacttttttaatttttactatccactccaaattaaacacaaccgatgattttaataattggaagcttttaaaaatatttcaaaacaagcctctttgtgtttgtctatatatatacacgtaataagaaggtgaatgaatctcacagcttacttgttctaaggcttccaataacgaaaacagta

SEQ ID NO: 903 - DNA, 702 bp, Arabidopsis thaliana
  misc_feature (1)..(702): Ceres Promoter PT0863
cgggaaacgacaatctgatctctagtccagtcgattggcccgatcggccgattataaacttacatgagacaagtataaataattattataaacttattaagtttaagatcaaggcttttgtgcaatgtatcaatgaatgttagatgtgatatgatgaaagcaatgttttaaacacatacatagtcattgatcggaatgtgtgttattagaaatgcatgcctaagccgatagggttatctatgtttggtcttggacattatagccaaatttcgaatctaattcttccaatatatatttttttttttttgcttagggccactactagtattgcttatcaattttaagagctcatgaaaatgcaacaatatagtagttgcaaatccttgtttcaagagaaatcaaagggccacttgtgaattgaataataataatatttgcaaataacctttcactaaaccataccaacaaaaccacacagatttggcaaagacataacctttgggagacgtgaaaaggctcaaaatttgacaattgtccttacaaattcgctcattagtgcaattgtgagatttgtttgcatccaaatccaattcataactcacactcgtctcaaattcgaaaaggcctgcagggccagtgcactgggatccaacaatgtcctccgactcgtccaagatcaagaggaagcggaaccgcaccgcg

SEQ ID NO: 904 - DNA, 435 bp, Arabidopsis thaliana
  misc_feature (1)..(435): Ceres Promoter PT0879
ttctaggaagactggtcaagctaagctgtttctgttttttgtttttgtactttactttttgtttgctagtgggaactgggtttattgggccttgaagttgataaaagatgaataaaagacatatcgcctaaagcccatatgagaagcagaagacaaaaacctccaactttgggcataaattttgattatagttaaaagtccagacccaatttggcacctggcttagttacgattctaaggcatgacacctgcctaatatgtttattacagaaaataaagagaatcagctaggtgtcccttattgaacacattaacaaactccaacgacactacgtgtcttcgtgactcttactatatccaaaaacctatagctaaagctgaattttccatgattagtatagtcccaaccaaaaaaatactgaagaaggcataagc

SEQ ID NO: 905 - DNA, 397 bp, Arabidopsis thaliana
  misc_feature (1)..(397): Ceres Promoter PT0886
agtgtatttgaaaacgacattgaagaattaatatatttttttttaattttagttttttatagtacaaatattaaaacaaacaatcctaccatatcataacatttgtaaataacattttaagttttgttttgagttttaattaattttctatgacaaaaaaatgaagtcaatagactaagtgaatcatatagtataaataaacacaatttaaatagtttcaaataaatttagaaagaataaaacaaatagaaatcagaaggtgtctgtttcctcctcgcaacatacgatcaaagagaaacaacttgaccctttacattgctcaagagctcatctcttccctctacaaaaatggccgcacgtctccaaccttctcccaactccttcttccgccatcatc

SEQ ID NO: 906 - DNA, 1024 bp, Arabidopsis thaliana
  misc_feature (1)..(1024): Ceres Promoter YP0007
agcagaacaactatatttattgtgtcacataaatctgagatcatttataaccaccaaagaacctatacacagtaaatgacaaatgtatctccctctatctctattgcccatatgtagatgctaaagtaagatttctcttttttttaatgtacttttttttgtataaagtatattccataagaaaaaggaaaagcttgtttatggatcaattgaccccaaaaaaagtttttagatcaaagcccaatataaaaaaaaaacacagtagtgacacaaaggaacttaaataaaccatgaattgatctataaacagtagagatcgataaggcgaacattttccatgtgaagtgtcttctttcatctataatatttttgacatccaataatttcctctataatatcattcacataattgatagaaacattatgttagaattgtccacatcatttgagctgtaatatattctgttttaacaaattatatggtagttgcttaatcttatgtccatcttcttctatgcatcgttttcgcgcctagttgtccagtccatttcaactacctacctctaattcttatcttaaaacaacattttttaatttaagtattatgctcaaagactaactagatagaaaaccgttattaaacattaaacgaattaaaagtcttacatggaaaatgtaggtttataaaccacgagttatgattgacaataaaaaaaatgcaaatcatcaatcaaaagagacttgagtgcgactctatatcaaccattgcaattaaaattatctatcacaaaaattttagacagattaagttaatttagtctaaattcactaatttattttctataattagtaattaactatatttatttatttacacattttctgataatttagaaatttgcatgaataacaaatataagattttggaaattagtagcaaatttaattaataattatttttgcctaaatgaaccaaactataaaacctccacatacaccagtcatcaaatttacagagacaaca

SEQ ID NO: 907 - DNA, 1000 bp, Arabidopsis thaliana
  misc_feature (1)..(1000): Ceres Promoter YP0008
ctcgagagatgaagtcttagtaatgtttgaacaaacaataatcacgttttccatcaaattcgagcatttaaagtttatattactacatgccccaagatgataccgtccatctcatccgaaaatatttctgaaattgcgctaagacaacaatgtttgctcaaattcgatcatttaaagtttacaaatctctcatcaatcttacaaacttctcacactaaacagaggtacatattttcttataaagacaaaaggttcgaacagctggcttctcaactcgagttgtttgtcagggcctctcttcactaactacaagttggtacttcaaatattggtggctagcttcacgtgatattgtctacaaattaaacccatgaaaaagctgcattaattgttccaagtgaaccctgaggagtgtcaatagtctttgctttagtgtgatcattaaaccaaatctctaaattcctaatttgtactaacatttggaacgtatttcctactcttctccctgctccaactcccaaaaataagattagttagatttctataactaatatacatgtatactcccaaaaacagtaaaaccatattaataaagctaattttgcatagatttatttcggtaaaccggcggttcaagttggggaaaaaaaagacaaacggtctaaagtcatccaaagacaaaaaaccaaagacaagttgagagagacgagaccaatcacaacattgcttcgtagattgcgtgacatcatccttgacggctactttcatttgtgtcttatttggataaaacgcacgtgtttaattcacgaaccttcatagcaataagaaatttccattactttcatattttcaactttttttattacccattacatgcttaaaatattaattcacaagtctttgtcaaaattcaatattttccaggttcatgaaccctttttatctcaatctactctataatatctccctataaattacaacaaaacctctttatttttca

SEQ ID NO: 908 - DNA, 1024 bp, Arabidopsis thaliana
  misc_feature (1)..(1024): Ceres Promoter YP0028
gtcagtgaagtcgattggtagtacttgaaacacttggttggtttcatgtatttggcctatatataaacaaacatcgtaattatatacggatttttttcggaattttacgccatatctgtaagtatatataacatgcatgtcgttttcaaattcatatgatgaacgatccacgtaagtgctactactcctacaatattgcatgagagagatatgtatttataaattttattttgaagaagaaataagagggaaggttacttgggtggatcgatgtgaaaacaaaagaagaaaaagcgaaacccactaagccattacatgatatcgaccttcttatctttttcctctttattttatttttctcatcttctttttgtcaggacttttttctacttaatgaaacctccaaactatctaactaatacactcccatgtagaataaagaaaattatataagatattgttgatattttgtaactagaaaatatatttgctctgtaatttttcgtaagttaaatcaacattttaaagtagaaacaaatattactgcaaaaagtaggatcattatttttgtccaaaatctcagttagctatagggttgtagtaaaaacaaaacacattcttgatttgccccaaaaaataaagagagagaagaatattgttcaaaagtggtctcttctctctctaattatgttttcactaaacccaattagattcaaacagtctacaaagtccaaaagataaacatgggacaacaattcgatgcaaaaaatcctcttttcatgctctttttttattctctagtcttttaaattactaataaaaactcacaaatccaccaaacccattctctacaactcaccttcatctagatttacccactcccaccgagaaacacaagaaaaaaaatatacatatataaatatacaagacaacacatgatgctgatgcaatatacacaacaaagtattaaatcttagatattgtgggtctccctttcttctattcattttcttattcattaaaa

SEQ ID NO: 909 - DNA, 1024 bp, Arabidopsis thaliana
  misc_feature (1)..(1024): Ceres Promoter YP0039
ccgttcgagtatttgaaaatttcgggtacacccgcctaaataggcggaccttatctagtatatatatacatttgaactatattgtttactttttagttgatttaggctatgtcatgacattgacataaatctacctgttatttatcacgtgtaattcgtgtaaagtgtaaactagaaagttcaaatacgtatttgtttttgttctgttatataggattgtcatagttgtaaatctacaatttattacaacatgaataagtacacaagcaatgtaattggatttaattgctaaactctttacatggtcaatctaaatttgataagaaatacgtcacatattactaagactgatagtttttttgttgtcaccaattatttttgttaaattgacgaaaacaattccaaaaactcaaatgtacaaaatcatacagtctcacaaacatctcatagagaaagatataaatctcccatatgggaacgataacacgaggtcgaaatactattcgtaaaactaaaacgccttagttataaatcgttagttgtaaccgcggtcgagaatacatacagatccacgaaactactactacacatgctgctgaattggaatttggaaaagaccatcttctttaggaagagctcacccaatgagtgacaaaggtgtcggtggcttgttttctacccatatgtatacatcaaatggtagtttcattaacgtttggttttgagaaaagtaagactttggctagtagctaggttcgtatataataaactcttttgagaaagttcatcactggtggaaaatgttaaaccggttttttctcattttttccgccatgttaaccaccggtttaaaaagaccgtaacacattgaaagattaataagggtatatttgtaattacggtttgctggcaatttttaattattattttaattagagaaaatagagaagccctatcaatgtacatggtatatatataaaaggcaaaaccctagaaaacgatactattcgactcagccgtcctt

SEQ ID NO: 910 - DNA, 1024 bp, Arabidopsis thaliana
  misc_feature (1)..(1024): Ceres Promoter YP0050
aatctgatctctagtccagtcgattggtacttgagggaaacatcatatttttaaaccttgtctcagtaagctaacacacaccccttgtgattacttatccatgtttatccacaagaatgcagttggattgagatattttcttctttgttgaaatcaggcctcaaggtgttcatgtggtctgcaaaaaaattcccaaaaataaagatagtgacatctgaaatcgataatggattagacgaagagtttcgtgttattccttggtatgggcgggtttggggacagatattttggcacagacgaggactaggccactgtggtcctgcagcattaggtgtcccttccatgtcctgcattacattttattgatggattcatcaccctatctactacaacggctacacaaactatgaagagttttgtttactaataaatgcccaagtgaggggtcgatcgaacccgggacacgtttttcagtttaccatatagaattatccttggaacccttgatactccatagaacatcaccacctctgttgtcatctcaggaatccaggttcaaacctagtctctctctccctagtgggaggtatatggccactgggccaatgatgacaaaatgcaaaaaaaataaaatacatttgggttcattatctaaaatatctcttgtgtttgtaagttttggttgcacactcgtgtggttgaagtgtgtgtgagaggtactatacaatacactctgcttttgttttgtacctatctctttctcttctccacatatccaagactttggggataaagctgagatcattggttgccatttggttgtgtagaagcaatcacccatttgctttatccgaggttgataaatttcctcgggttctccttctgacacgtatgacaaattctaatagtatattcctcgtagatattacctatatattctcaatagttgcaggtacttaaggctttgtcttggcatcctcgtcctcttcagcaaaactcgtctctcttgcactccaaaaagcaa

SEQ ID NO: 911 - DNA, 999 bp, Arabidopsis thaliana
  misc_feature (1)..(999): Ceres Promoter YP0086
cttatcctttaacaatgaacaggtttttagaggtagcttgatgattcctgcacatgtgatcttggcttcaggcttaattttccaggtaaagcattatgagatactcttatatctcttacatacttttgagataatgcacaagaacttcataactatatgctttagtttctgcatttgacactgccaaattcattaatctctaatatctttgttgttgatctttggtagacatgggtactagaaaaagcaaactacaccaaggtaaaatacttttgtacaaacataaactcgttatcacggaacatcaatggagtgtatatctaacggagtgtagaaacatttgattattgcaggaagctatctcaggatattatcggtttatatggaatctcttctacgcagagtatctgttattccccttcctctagctttcaatttcatggtgaggatatgcagttttctttgtatatcattcttcttcttctttgtagcttggagtcaaaatcggttccttcatgtacatacatcaaggatatgtccttctgaatttttatatcttgcaataaaaatgcttgtaccaattgaaacaccagctttttgagttctatgatcactgacttggttctaaccaaaaaaaaaaaaatgtttaatttacatatctaaaagtaggtttagggaaacctaaacagtaaaatatttgtatattattcgaatttcactcatcataaaaacttaaattgcaccataaaattttgttttactattaatgatgtaatttgtgtaacttaagataaaaataatattccgtaagttaaccggctaaaaccacgtataaaccagggaacctgttaaaccggttctttactggataaagaaatgaaagcccatgtagacagctccattagagcccaaaccctaaatttctcatctatataaaaggagtgacattagggtttttgttcgtcctcttaaagcttctcgttttctctgccgtctctc

SEQ ID NO: 912 - DNA, 1024 bp, Arabidopsis thaliana
  misc_feature (1)..(1024): Ceres Promoter YP0088
tcgattgggattactacttcatctagtaaggttctgaaaacgtttgttgttgataaggaagattcgtctcaggttattactgttgatcttcaaggtttgtgattgtgacgcttatacatgtgctgaaactgtggtgtttatttattgaaaacaaaaaaaaagtctctcttgtagtttcattgtactaaatagaaaacaagaaacgtttttttctttaatcttctacattgataatattggatcaaaggattgtttctgcaagacacaacacaaacatacttatactagtttacttctactaagtactaactacatacccatacacacacttgcacctagactttacttctagacatcattaccctaaggtagaaccaagcttacaagcaagttttaccgacaactcttacattacaactctagtctgtagtctttaacgtagacttactaactagtcattagtggtttaattttttaaattttcatccatatgtttttgttgtagatataaactaaagtcggtcacatttaataattgtcattatgtccgcgtaaaagtcaattcagctattggacatttatgaaatgtaagattttctctctcatttccccgtgcgtgaagacatgcattggtttttctgtaataatcaacaaatccaaaccccttttcgatctttatttggacattgttagagacaaaatttctctatagtctttttcctaatttgataccatgtttttgtttctgcacaaatttactcactggtttaactaactatccacttatttatgattttaccattaggcgtcagctagccctagtcaaatttgtaaacaagccaagctatctacataaatcgagatgtcattaacgttaatcgtcgttaattcgaatttgaaaacatagatagctttagcagtacaatgggcaatggtaagaagaatagcaaaaggcccaatatttggtttgcagaaattaaagccttaaaaaaaagcccacagatatttgtcaaagaaccctaat

SEQ ID NO: 913 - DNA, 1024 bp, Arabidopsis thaliana
  misc_feature (1)..(1024): Ceres Promoter YP0092
aaagattgagttgagagagatggtggagacgcagaacagacaaagggagtttaccatatagtgctctaaagggcaatgagattgcagtgatgtggctatccggggaatcatcgcaggttattccttcccatgagcaacaatcaatggatgggttccaattcagaggagaaacagaagaagaaacgtttccagagaaccacagtagggattctcgatcttgcgagttgcagagagcctctgaaactgcaatagaaaggacactgatgaaaagaacacactgaaggagtatgccaatcatgtgaaaactcagagcttgtattggtcttgtggttgatgaagttctcacaaaacctttggctttgaatctcccctcattagtcatggtgagaacaagaacaagacgagaaacagacaaagaagatgaaaaaacttgttggccagtgttgactaagggggaatagccccagacataacaaaattagacttgtcgtacatctttaatatttttttatctgtttctttgtcctgacgctttcattattcctgtgatcaattttctcataccattggtccatcgttaatcctttcttaatttcattttctacgtaacatgagaggagaccaagtcctatgagaacagttgacgtaacagtggttgttaagttaagttaaaaagaggaagctagtgagagtgaccgttaggtagagaagtgagatctttaaccactcttctttctctctctctctgcttttttcgtcgtctttcacatctactgttcgcaaactctcttatgcttccaataatggtgataccaattgagacttgcaggagaatctcctcttctccacactctatcaactggtcagccatggaatggtcgtttcagtttcaatattcctggattctttttaaggattcctgtttctcttctgttcctggtatattcttaacgacgaaattagtatcggatcctggtaatacattttgaagcttttaagtaccattgcactgggatccaacaat

SEQ ID NO: 914 - DNA, 1020 bp, Arabidopsis thaliana
  misc_feature (1)..(1020): Ceres Promoter YP0096
gaggtcagtgagtcgattggtgcaaaattgaaaaattgaagggtgaaacaaatttaaagataatatctattaaatcctctaattttaaaaatttagcaaaaattgtattttcttatggatctgttagttcacacgtatcttaattagtaccaaatcatatctaatgattagtgataaaactagttagatatctatatgtgtctttaccatttaacttgaatccttcttcttttttttacgtaaacaacttgaatccttcgttaatacataaatttaaagcattttttctttaattctattgatcggtatatatttactataagttttagctcatatgcaatttcaaatgatatgcttttaaattttgtctaggtgtgatagttgtatctttaacataaatcttatagcaaaattatacttgatattctaaatttatctatttgctcttgtgaacctcatattagtctagagaaactttgaaatcctttcaattagttgtatgtccaatacatttttactaacatttattagtctttttaattaagattattgttagaaaaaaaaagattttttaaaaataaataatatgttttagatacaatgtgagttaggcttcttatattttaaaaaataaatttatttcatacttaaaaatagtttggaatttcaatttatttggctgaataccataaaatatgtcaatttgaaccttatacccattgactatttggtgttagaaaccctttaacaaaaaaaaactatttggtgttagatatcaaaataaaaaaagtttaaccattggtttcttatattgaattggatattgttacatgtattaaagtttttttggtttaattttgaaacgttgatagaaactattaagtttaagtttggtagtatatttatttgtggaaaatttaattgccattaaatataacgtcaactttttttggttttttttgagaagttacgttgtgattttgatttcctatataaaagttagattacgtcattttttaa

SEQ ID NO: 915 - DNA, 1000 bp, Arabidopsis thaliana
  misc_feature (1)..(1000): Ceres Promoter YP0097
ttcatctttatatttaagagtttaaaaactgcaacttttgtttttctttcactaagtcttatggccacagttaattaaaagcagatgaaaggtggtccaatggaaaaggagaatgtgattgggctagttgggagagttctgatgtctagtgttgggtacacgtgtccgtcagttacacatagcattaaatcagacggcatgtcattattcaaatctagttcacatagtacgactaatagctgataaattaatgattatacagcatatgaattatgaattcaaaaaaaaaaaaaaattgaaaatgttaaggagatgctatattttacaaaattcatcgcaatgctttctactaatttgctaagtggtcttctccagttagtcttgtcgattccaagcgatattattaaatcttgaagcatcgctcaaagcattatagcttaagataaccaaattgttattaaaaacacctagtgaaatttttaaattaaaacaattttgatatctttgtaatatctaatactactctttctgtgtctaaaaggattaattttcaaaaatttcacacatattaaaaaaaaaaaaaaattactagctaaacaattttcaataatcataaaacaatagtaacttaataatttttttttattttcaaaatagtccttcaagtttacaattcattttagtattataatcaacaaaatttgtattaaaaagttggaaaattaatctttgtggaacaaaaaaatctagaaatcattttttagaattagagagaggtttgataaaaaaaaataaaaaaaaatagagagaggtagtacatactaaacgatgtgatactactattgacaaaatcttaattctcagtttagtagaataaactagaaggaatgaatgaagtaaatgcgaatccaactactaacaaaccctacttagtcatcatattttcccatatgaaatccctatataaacccatcatcatctcccacttttttcatatcca

SEQ ID NO: 916 - DNA, 1004 bp, Arabidopsis thaliana
  misc_feature (1)..(1004): Ceres Promoter YP0101
ttctcgttctctagaatattgctggaccggattaggtcaatattattgggccagattagatattgaattgtcgacgttgcttacgttacgttatatcttgtttaagaattaaacctatcgacttagtcttaattaagaaaacattgccttaaattctctggtctgcgaccgtttttttgaccgttaacccctaattaaagaaacaaaataattatagaaagagcactgaaatgtgattattttaacagtactcttatgagaaaattcgtactttttagttttttttttgtacaaatctctaagaaaaacactactactaattaagaaacgtttcaaacaattttattttcgttggctcataatctttctttctcggtccgggactaaccgttggcaaaaaaaaaaaaaaagttgacaataattattaaagcgtaaatcatacctctcaaataaaaacttgaatttggaaacaaagacaactaaaaaactcgaatttaagagaattcctaaaatcaagtgaagtatcatcacttggtaaaatttcataaccgttggcttctatttctatgtgtgccttggtttgcaggagataatatttcatttccaaccaatgatattcgtacacatagtcaaacaaatgtttgtctttgttattatattgagaaagaaacaagaaagagagagagagatagataagacgaaggaagtgaagcttccaagcgcccaccgttaaaaatctcgtgtgcaagtttcaaatacaagtggccggtggtctccataatttgatcgtcatccaattaaaaaggaagaaaaagcgtgttttatacaagaaaactcattaaaatagcaagtctagaaatatctcaacactaatctaccacgtctattacacacacacacacacacacttgatcttaatttattttcaagattcaagaaaatacccattccattaccacaacttgaccacacgcctatatataaaacataaaagccctttcccc

SEQ ID NO: 917 - DNA, 1000 bp, Arabidopsis thaliana
  misc_feature (1)..(1000): Ceres Promoter YP0102
atttggttgataacgttttcactcgactaattatatacttcagaaggatagtaatagaataccaaaataattaaatgattggttagtgccttagtggagactttttaaccgattctaatagactaatgatgtagctaagcatttatttgggatcatcactgtttgaaaacgtgaaatgtgataaaagttatgaaacgattaaaatataaaataaccgtacaaaacattatgtaccgtttttttctctgttcttttggcgatttggtttagttcgttacactctaaatgttattgcagatatatatataatgatgcatttgcatctgaggaacatataattccggttaacacttccaaatcttatatccgtctaggtagggattttataaatcatttgtgtcatcatgcgttatgcttgtcggctttgaccataacgcagagatatagaactagcttttacttaacttttagatttattatttgatctagagttaagtggagatatatagtgtttttgttagattattggtggatgtgagagtttgtctttagtttcaagttgagaatataaggcaagaggagactctgaggcaatcagaggttttgattggcaaaatatccaaaaggcccaaaccaagtcgaagcccatctcgtacaaaaaaagaaagagatctgtaagaaaaaatattctttgatattcttacaaaaataagtgtaaaacttttattagtcaaaatcttcaatctttaaaaactctcatcactcctacgaaagcgcgtgagagttatgagacattccttaatagcattactcacaagtcacaagttcaaaacgtctgactgaaacagaaacaagcctttgttgaagtcttgaagaagagacattagtactcgtcgtatagccataaaaggtaatatacgaaatttcttcgctaatctcttcaccttcctctacgcgtttcactttcactttataaatccaaatctcccttcgaaaacat

SEQ ID NO: 918 - DNA, 1004 bp, Arabidopsis thaliana
  misc_feature (1)..(1004): Ceres Promoter YP0103
gttttgaagaacaatctggatcgaaatctaacataaggtcatcgtattcaagttacgcagtcaaggacttgacatcatcctactctggtctgaggttaccacttccaaagatgggatttttcgactcggtatgcttcctaagaaattcgttttattgaacctagcaaatatcttgtaatgtaagattcctgagatgatgaagaaaaaacaaacttttgttacagcaggagaacggagagaaagaaaacagagaaccaaatgctcttgaagcaaacagaagaagaagacacaaatccaaacttgagacttcttctacaccagaaaaccgcagcattctgggacaacgcaaaacacgaaagtgaaacgggcaatgatatatatgtcttgggtgcgttacaaggcatcgtttgcaactgttgagttggataagtcaactgtcttcttttcctttggttgtagtagctgccttttttttcctttgttgctttaagaaatagcccgaaaaaaagaatgttctacatttcggagcagaaaactaaccgaatgagtttttggtcggatcatcggatcgatcagatatattttgagttacgaactgttataaaaaaagccataattttgtgttgagtttgcaaaataccttataacttgttatttgagattgcacctccatatatattaattcgtaagagtatttattaagtaagctttagtataaatccttttttcctttaaagtaagttaatgttctactaaataatagtaaagttgaagaaccgctccgtttttacaccatgcacgtgttatctaacaaagaaaatatggtacacctaatggctaatgcaaaggacaacacaatgaaactaacttgactctgtgttatagaaacccatagacatctgcatacatcctagtatttgtataaattggactcaaattcctgaggacaatcatagcaaacaatcacatcatcgcaatatacataaacaaaagaggaagaaaaa

SEQ ID NO: 919 - DNA, 1003 bp, Arabidopsis thaliana
  misc_feature (1)..(1003): Ceres Promoter YP0107
taacaatccttgggaacattgcatccatagatatccggttaagatcgatctttgaactcataaaaactagtagattggttggttggtttccatgtaccagaaggcttaccctattagttgaaagttgaaactttgttccctactcaattcctagttgtgtaaatgtatgtatatgtaatgtgtataaaacgtagtacttaaatgactaggagtggttcttgagaccgatgagagatgggagcagaactaaagatgatgacataattaagaacgaatttgaaaggctcttaggtttgaatcctattcgagaatgtttttgtcaaagatagtggcgattttgaaccaaagaaaacatttaaaaaatcagtatccggttacgttcatgcaaatagaaagtggtctaggatctgattgtaattttagacttaaagagtctcttaagattcaatcctggctgtgtacaaaactacaaataatctattttagactatttgggccttaactaaacttccactccattatttactgaggttagagaatagacttgcgaataaacacattccccgagaaatactcatgatcccataattagtcggagggtatgccaatcagatctaagaacacacattccctcaaattttaatgcacatgtaatcatagtttagcacaattcaaaaataatgtagtattaaagacagaaatttgtagacttttttttggcgttaaaagaagactaagtttatacgtacattttattttaagtggaaaaccgaaattttccatcgaaatatatgaatttagtatatatatttctgcaatgtactattttgctattttggcaactttcagtggactactactttattacaatgtgtatggatgcatgagtttgagtatacacatgtctaaatgcatgctttgtaaaacgtaacggaccacaaaagaggatccatacaaatacatctcatagcttcctccattattttccgacacaaacagagca

SEQ ID NO: 920 - DNA, 1024 bp, Arabidopsis thaliana
  misc_feature (1)..(1024): Ceres Promoter YP0110
gggatgcggttccgcttcctcttgatcttggacgagtcggaggacattgttggatcccagtgcaatggtaatataaaacaagaaaacaagagattttataggacaatcactaaatgacatttaattgattaaacatttattcattaataattgtatgttactaacttcaacatttaataattttgtttaagatacgtttacatcagagactattaatatttttacaggttgtaactttaaactttgtcttgaatcgaacatgactatagattttgggcaaacttaaagataacaacatttccgttttttttcaaattattacaaatcaaactgatatattagacacaacacgattacacgtaatgaaaaaagaaaaagataaaaagataaaagaagggatcgattctgtttggtctggtttagtgagattcaaagttaagctcttcctttcaagacatgccttcttaaaccgggaatgtgaacgtttgtaatgtagtccgtccagttaatgcttccaacatcaaatccaaattctctcttctcgtcctctgacatattctccattaatctctggggtattgctgttatcaaatctgtaaaagaaaccaaaaaaaaaagatgaaaactttgcgggtaccggttttgtctgctctaagaattagaatgttaatgagttctgtcttaccttccaccatagaaagtgtatggctcataaatagtagcaaggtgtttggcttgttcaacagatttcttgcatataaactttagcttctgcatcatcttactatccactgaactcataccactcatcaacccactccgttcttgagcatctctccacaaatgatccgagaaatcatcaacggaattgaaaagtttcatcaaacgcaccataataggatcacctttagagtccatgcatggagatgttttgtagtggttataaagaagctccgctaagtcttcgaaaaccagcgggtttatcgccgaagaagcgatctgatacacgtttatttcaggttcc

SEQ ID NO: 921 - DNA, 1024 bp, Arabidopsis thaliana
  misc_feature (1)..(1024): Ceres Promoter YP0111
cgattggatttagtctatacattatagggcgcaagtttgtggatttaagaattatataaaaacttgaaatatatagtttttatgcattctcctcttgtgtaatacataaaccaaatatgagataggttaatctgtatttcagataatattaaattccaaacaatatttttacttgttataagaaggcaattaatatctctctgttaatggcaagtggtaccaagtagtattaaactattaatgcaatggaagagtactgttggaaattataatcctctatcacacattcaaacagatctcctgaaatcttctcttccaaacttgtacttctctgatccaaatgtaggctccaaaatatagacatttaccatttactaagtccacaactcctttcttgtctccttcaaaaatgactcttgtgtaaccaccatatgactccgacagttcggcattgccatgatgagagcttaaaaattcaccttcctgagcatttcaagtcttcactcccttagcttgacctgaaccaagataaaatgcctttgtcgtcccgtaatatccatcctgctttggacggcatcatagttacattcgatccatcctatttacaatgttattttagtattaaaaacatgacaataaatttgttgttaaacatattcaaatacaatatgattggatttataagtaattgtaatatgaaatgtccttagtaatatgttaaaaaatacatagatacacacacgtactaaaagaggcaacgcgggagatgtcattagaggaagaactaggaagcagagcgttcatgcaaaatgctaccaaaaacgttaatgcaatatctcaactaatcagcacagtccatttcatactgagaatgtaaaaaccaatcagcatcgtccattttttcatctaattatttgttaactcttaattggccacaacttccaaccacatgacgctctttctattccctttatatattcccatctcaaatgttcttggagacacaaaatatcataaacatata

SEQ ID NO: 922 - DNA, 996 bp, Arabidopsis thaliana
  misc_feature (1)..(996): Ceres Promoter YP0115
gtcgattggatgatgaacattctacatatataattattatgtttaagcacttagacagcataaattctttctaattatataaatctaaccttgttacattgtacatctataaattacttgaagaaataacgagttctatttctttttaaaaattaaaaatactataccatatctcagtgattaagttgaaccaaaaggtacggaggagaaacaagcatttgattcttccttattttattttattcatctctcactaatgatggtggagaaaaaaagaaaatacctaacaaacaaatatatattgtcatacaaaaatatttctatatttttagttaattagtttatattcctcacttttcagggcttatataagaaagtgagcaaacacaaatcaaaatgcagcagcaaatactatcatcacccatctccttagttctattttataattcctcttctttttgttcatagctttgtaattatagtcttatttctctttaaggctcaataagaggaggtactattactacacttctctctacttttacttgtattttagcattaaaatcctaaaatccgttttaaattcaaaaataaacttagagatgtttaatctcgattcggtttttcggctttaggagaataattatatgaaattagtatggatatctttactagtttccattcaaatgattctgatttcaatctaatactctcactctttaattaaactatatgtagtgtaatttcacactgttaaatttctaccatgtcatgtatattagagttgcatagaaaattgtaaaacatccatttgaattcgaatgaaacaaaatgttttaaaataaaattttggtttttaaaagaaaaatctaaaactgaattatatcgtttaaccaagttgtaaaagtcataaaacgtagtatcttgtaaatcgctcttccacggtccaaatagacttctagtaataaacaagtaaaactaattttggtttcttac

SEQ ID NO: 923 - DNA, 1024 bp, Arabidopsis thaliana
  misc_feature (1)..(1024): Ceres Promoter YP0117
gtcagtgagtcgattggatcacagtcctttatgataaaacaaactcataattattccaccgacaacatgcgttttaaattattttttcttaaattatattatattatattgatatcaacctagctaaaataattcggatggcgaaatcggacaatttttaatagaaaaaatgggtatgaagatagtctatgattccgttcttagcgactagagggacctgctcaaatctcccgggtgatacgcgatgtcaagctcaatagaaccccacaaccgacgagaccgagaaatccttgatttgggctagaagattttgaaataaatttaatatattctaagtaacttgcttaaattttttttcaaactctaaagacataactaacataaagtaaaaaaaaaaaagttaatacatgggaagaaaaaaattaaactaatgattagctctctaacgtgtttaatctcgtatcaagtttttttttaaaaattatattgctattaaaacattgtactattgtttctattttgtttagctattattcttgtgaaatgaaaagttgtgtttattcaattactaaatggcaatatttatcttggaaaactatacctctaattggattaggccctagacatcctctttagcttattgacgttaaaattattcccaaaactattaaagtttagtagtttgaaagatgcatcaagacctactcagataggtaaaagtagaaaactacagttagtgtgattatattttaaaatatataaaacaatcttattaaactaaatattcaagatatatactcaaatggaagataaaaacatttagtctgttaccactaccagcctagctagtcactaatagtcactttggaactgagtagatatttgcatcttgagttaccatggactcaaaagtccaaaaagagaccccgagtgaaaatgctaccaacttaataacaaagaagcatttacagcggtcaaaaagtatctataaatgtttacacaacagtagtcataagcaccattg

SEQ ID NO: 924 - DNA, 1000 bp, Arabidopsis thaliana
  misc_feature (1)..(1000): Ceres Promoter YP0119
taccaaaaataaggagtttccaaaagatggttctgatgagaaacagagcccatccctctccttttccccttcccatgaaagaaatcggatggtcctccttcaatgtcctccacctactcttctcttctttctttttttctttcttattattaaccatttaattaatttccccttcaatttcagtttctagttctgtaaaaagaaaatacacatctcacttatagatatccatatctatttatatgcatgtatagagaataaaaaagtgtgagtttctaggtatgttgagtatgtgctgtttggacaattgttagatgatctgtccatttttttcttttttcttctgtgtataaatatatttgagcacaaagaaaaactaataaccttctgttttcagcaagtagggtcttataaccttcaaagaaatattccttcaattgaaaacccataaaccaaaatagatattacaaaaggaaagagagatattttcaagaacaacataattagaaaagcagaagcagcagttaagtggtactgagataaatgatatagtttctcttcaagaacagtttctcattacccaccttctcctttttgctgatctatcgtaatcttgagaactcaggtaaggttgtgaatattatgcaccattcattaaccctaaaaataagagatttaaaataaatgtttcttctttctctgattcttgtgtaaccaattcatgggtttgatatgtttcttggttattgcttatcaacaaagagatttgatcattataaagtagattaataactcttaaacacacaaagtttctttattttttagttacatccctaattctagaccagaacatggatttgatctatttcttggttatgtattcttgatcaggaaaagggatttgatcatcaagattagccttctctctctctctctagatatctttcttgaatttagaaatctttatttaattatttggtgatgtcatatataggatcaa

SEQ ID NO: 925 - DNA, 999 bp, Arabidopsis thaliana
  misc_feature (1)..(999): Ceres Promoter YP0120
tagtttttgatttaatctacgtttttcttaatcataaatgggtaattattagtttttgcaaaatcaaaatccaaaaattgttctaaacactgcaaccatttaaggcctatatcactcagaaaatttctggtgggagaactaatcgtttgtcctttctaaatctcacatattagaatttagaattagtgtgctacataagaatattagttcagctcggaacaactattttttggtaaaacagagaacttaaacaaatgcattattttatcaacatgcattttgaattgaatataaaatttcataattgtaaagacataaattacataaaattttacatgaaaaaatagatatagaaagaaaatgaaactaactgatgatatgctctctaaattttttaatctcataacaagaattcaaattaattagttcatatttttggttaatataacatttacctgtctaagttggaactttcatttttttctgttttgtttagtcagtattcttaatgtgaaacggaaagttgaatttattcaaacttaaattcaatagcattaattaaaggcgaaagctattatctctacatgtggttcaaactagacatccaatttaattagcttattgacgttgaaatgttttccaaaactactatagtttggcaatttgaaagatgcatcagaactactcagacaggtaaaagtagaacctctagctgtgtgaattgtatgttagtccataaagaacatcttgtaaacttcatacttaagatatatattacaatatatacttgaatggtagataaaaacgattagtctgattgctagcatactcacaactatttggaaatgagtaagatattggcattctagagttactactatggagacaaaagtcgaataaaagagacctcacgtgaaaatgttacgagctagtaaaaaaagcatttacactaacggtaaaaaaagtatctataaatgtttacacaaggtagtagtcatt

SEQ ID NO: 926 - DNA, 999 bp, Arabidopsis thaliana
  misc_feature (1)..(999): Ceres Promoter YP0121
ttggattttttttttgttgagtcagcagaccatctaatctctctttttccaccacagcctgctttctatgaagcatttgggcttacggttgtggaatcaatgacttgtgcactcccaacgtttgctacctgtcatggtggacccgcagagattatcgaaaacggagtttctgggttccacattgacccatatcatccagaccaggttgcagctaccttggtcagcttctttgagacctgtaacaccaatccaaatcattgggttaaaatctctgaaggagggctcaagcgaatctatgaaaggttggcccattctccttgacaggcttaacaatacaacttgtatcgcttcaacaagatgatggcttaataaggatttttgcatgtataggtacacatggaagaagtactcagagagactgcttaccctggctggagtctatgcattctggaaacatgtgtctaagctcgaaaggagagaaacacgacgttacctagagatgttttactcattgaaatttcgtgatttggttagtgtaacccactgttattcttttgatgtctacatctactttacttacattattcttttcttcggtttgcaggccaattcaatcccgctggcaacagatgagaactgatcatgacagggtaggattttatttcctgcactttctttagatcttttgtttgtgttatcttgaataaaaattgttgggttttgtttccttcagtggtttgattttggacttatttgtgttaatgttgttttggctgttctcttaatatcaataacaaataaatttactggttggtatctaagatctaacaatagttactatttttagaggtaaagacaccaaccttgttatattggtcagagagctaaaaccttgacttgttgggaaaacaaaactctaatgacagaaaatctgacatgatgccttataattcacagcctcatgttctacataaatcctaacaatagcactttgtttct

SEQ ID NO: 927 - DNA, 1004 bp, Arabidopsis thaliana
  misc_feature (1)..(1004): Ceres Promoter YP0128
gataaactgataatggaaaagaacaaagaaaccagtttttaactatttgcatatgtaatttatttgttgcaaattatatttagttaaaatgtttcctctatttatatatatatatatcagtcaagcactatgtataagaaatgtcaatttataaatttttacatgtcctttaacagaaagaaaatgaatttttacatgtcattcatagagagtcactcgtttatttcttatatagagaataacacactcacatgcatatgcatgcaatatgatacattttatgacaaagataatcaacggaaacggtcaagacataatttgataaacaacttgcacgatgcacagatctgatcaaatatataactctttaacatatccaaaatattcaaaaagaaaaactcgatccaaactagcaacatcacgctcacgcggtaggctaaaaatttattaatctccaaaagtctttcttatgaacactgcaaacacaacaacttgaaaagtcatataggtttagatgatgacgcgtattggctatcgcttaccggagtggctcataaatacaataaacaatacgtaaaagtcaaagtcaaatatatttagtcaactataaccattaatcgggcaaaacctttagctgtcaaaacaacgtgaaaacgatatttgtatatatcatcaagaatcagtagataagagaatgatttaatcccctgactattacaattttggtgtaataaacagtctctattggtttttattctttgttttaatttctcatgacctatagagagaattaggtagtttcgaaaattggctaatcaacttttgaaaactactgtctactttgcttaaattctctacacttagtttcggataagataattgtcggactaatagttaatcccttgacaatctttgatattataaaaggtttagttaatctcttctctatataaatattcatacaccagctttcaaaaatatataatccaaacaccaaaaacaaa

SEQ ID NO: 928 - DNA, 1001 bp, Arabidopsis thaliana
  misc_feature (1)..(1001): Ceres Promoter YP0137
gtggcacatgctgaaaccccgagcatctctccggaagacacgcgtcgttcgctccaaagaaaacagtcacagctgccggagaatctccgccgtcttcttctgccaccggaaaaactctctccaccactttcagtgcccacctcgtgttatatccactgtatcctcgtagcaccatatcagcctaataaaattttatgtatcaaattttaagacatagccgaaactacactatactagacaataataatatgatttgtttcctgaaaaattatggtttcatgagaaacattaatcatctataaaacaaattagctatggcatcgaagagttatcaatcaaaactgatgaatctttacttaatatatacaacatatctttaccttgcggcggagaagatcggcgagagaagcaccccagccaccgtcactaaaggattcttcagtgatggaatcaccaaagagaaaaaccttccgtctcatcatcttccacacaatcttcttgagaaaatctgagagataagaaaggtgtagtggttttgctgaagtgatcgtgtttgatttagtaaagaaatgctttatttattgttgggggaaacataaataaataaagtaaaagtggatgcactaaatgctttcacccactaatcaccgacctttcatggtttattgtgaaatacactcatagatagacatacaataccttatgtacgtaaataacattttatttgtcgacacttatgtaagtaacgcatagattattttctatgtgattgccactctcagactctcagtttcaaccaataataacaataactacaacaacattaatcataaacatatgctctggtttacaattaaagcttagattaagaaactgtaacaacgttacagaaaaaaaatgttatttacgttttgtaagattagtctctagaatcatcaccgttttttatatattaatgattctttcttatatataaaacctttctcgaaatacccatgaaa

SEQ ID NO: 929 - DNA, 1001 bp, Arabidopsis thaliana
  misc_feature (1)..(1001): Ceres Promoter YP0143
atacaacagatggcagatatcgagttaaatacgtgaatcagccgttacgatattttaaaactagaaaattatttaaaaatattgcaaaataccatttaatttcattgttcataaaaaaaagaaattcaaaaacttaaaaactgattcaaaaatttggattaattctcattaacagtcttcaacactacaacaacatgtttctaatttattttatattttaataattaaacaatatatacgtctgcacattgttgctccgacataatctagtataaaaatagttgcagcatatgtgaaaagcaagcagcatttatcactcaatacttttaattttatctgttgtatgtattaaggttttgtagctttaagaaaacgcttataatataaaataacttctaaaagatatttcatgcgtatacaataaatatttgtgaaaaaacatttcgaaaacgtgtacaatatataaactattgtgttatcttttgacattcaaacaaatgttgacaatgtaattttatccatgatatgattggccaattagctgcgaggtaaaaatccgtatacgagtaaaagtaagataaaatttcgcaagaagatttttagcaggaaatctaagacaagtgtcatgaacgtgtcaatcaacaaacgaaaaggagaattatagaatccagattcgacgtaccacattaataaatatcaaaacattttatgttattttatttttgctctggcagttacactctttttcattgctccaataaaaaaatcactcgcatgcatgcatatatatacaccatagtaaactccgcctcttcttcattttaaaagtatcagtttacactgacacaatccttaactattttcctttgttcttcttcatctttattacacatttttttcaaggtaacaaataatctttttaagtcacttttatactctttaaatcttagattgatatatgaatgcatgttaatatttcaagatttataggtctaccaaac

SEQ ID NO: 930 - DNA, 1003 bp, Arabidopsis thaliana
  misc_feature (1)..(1003): Ceres Promoter YP0144
aaacgttgcaagattattgattgtgagaaagagtgctcaaggtagtactgatttctgtaaagctcacggtggtgggaaacgatgttcttggggagatgggaaatgtgagaaaatttgctagaggaaagaagcggtttatgcgctgcgcataacactattatgtctcgggagaacaaagatggaagcaagagcggtttgattggaccgggactctttagtggccttgtttttggctctacttctgatcattctcagtctggagctagcgctgtctctgattgtactgattctgttgaacgaatacagtttgagaataggcagaagaacaagaagatgatgataccgatgcaggttctagtaccttcatcaatgaaatctccaagtaattcacatgaaggagaaacaaacatctatgacttcatggttccggaggagagagttcacggcggtgggctagtaatgtctttacttggtggctccattgatcgaaactgaaagccatttatggtaaaagtgtcacattctcagcaaaaacctgtgtaaagctgtaaaatgtgtgggaatctccgaatctgtttgtagccggttacgttatgctggatcaaaaactcaagatttgttggatattgttatgctggatcggtggtgaaaccacttcccggttgctaaataaataaacgtttttgttttataatctttttcactaaacggcagtatgggcctttagtgggcttcctttaagcgaccaatacaatcgtcgcaccggaatctactaccatttataggtttattcatgtaaaacctcggaaaatttgagagccacaacggtcaagagacaaaaacaacttgaagataaagggataaggaaggcttcctacatgatggacaacatttctttccacacaaattctcataataaaaatcttataatacaaatacttacgtcataatcattcaatctagtccccatgttttaaggtcctgtttcttgtctgatacaaat

SEQ ID NO: 931 - DNA, 1004 bp, Arabidopsis thaliana
  misc_feature (1)..(1004): Ceres Promoter YP0156
ttggtttgcattgtgaagatttgtattaactatagaacattgaattgatggtgttaagttcttacacaagcgtgcttctcggtttgaactgtttcttttgtatgttgaatcagagcttagtttataggaaccagagtatctacttagtcattctctgatgctaagtgctaaggttctacctagttgccctctaggcccttatgttattgataacttatgaagctatttgaacacttgattcttaggagacctaagttggtacagccagatagagtgtatgttcttgttctctatgtgacaggatcaagctgccacacatagttcaagggtatgctctgtgtgggtttgctcagattgaggacaaatctatacaaggaagtagagtctttgacattttgatgttgtatgataagaagaagaaaggagagtaataaagaaagagaaaagggaaacagaaacacgtgggagaacatcccaaagaggaagcacacgcggatcttcatgcaaagctccccgattctcccatgtggtccctttctccctttgtccccctcctctttcttcttttctcattttactcctttttttaccattatacaacgaatcttttttatcataattttttggttttggtttattttccaataacactttcttggttacttcccattctcactttttcatataagaaactcactttgggaaacttatgtttgagaatgacaagtctttttagagaaagtgatgtaacaaatctaaagtgattatataataaccttgcacaatgtttttgattttttgtaagattcgaatattaggtttattattcgtagggaataaacttactttcaaaagcgttcataagttaatactttcatatatgatcataagtacggacactattgttttttgtttgtttgtgtttattctaaaagaaagtagcttttaattgaaatgtcctcggaggcacagtttaaagttcgagtgtaacagtttctaaggca

SEQ ID NO: 932 - DNA, 1000 bp, Arabidopsis thaliana
  misc_feature (1)..(1000): Ceres Promoter YP0158
ttattagattaatagattgcattgcattgcttgtgctttcaatttacaaattgtctcccaactccatcgacacatctctttttgtgtatataagattcagacttgttatattttttttataaatatgttattagcatcttaagttaaattgattttttatatctgcattaaggattacacgactatatttgcgattgtgtgttggttaaaatataatttaggattgtctttaactacatttaggattatatgactatatttggttaaatataaaatctagctgtgattattagtattcaaaaataagtagcctaaccaattaaaacaacggctattggggcaaattagaacattttagtgtgtccaaaatataatggtcattaggtcatattcctcctagcttcatcgcagcataattgaatgattgccttatttagaagagcttttccactttcccaaaatctaggtgggatctttttgttttgaccttcatttttcttgtttaccatttttagctaaattatttacgattacaaaagatatcaaaagttggatcataatacaatttatagacttactgtagaaaattcgtatgtacaagtacaacaaattcttcataataaattttgaaaattctattacaaatgttgtaagaaatagaatttgaaatatatataaactaaggagaaaaaaaaagagaacatgcattgctctagtcagagtggaccaacatcaacgagataagataacataaaaaccaactcaccataactaaaaacatcccaagagatccaacgattcatatcaaacacaaaaacatcgaacgatcagatttaaaccatctctggtatctccaaaacacaaacacttttttttttcttttgtctgaatggaacaaaagcatgcgacatctctgtgtctttatcttctctctcctcttcttgaaaaactgaacctttaattctttcttcacatctcctttagctttctgaagctgcta

SEQ ID NO: 933 - DNA, 1005 bp, Arabidopsis thaliana
  misc_feature (1)..(1005): Ceres Promoter YP0188
gattggtatgaaatttcggagaccaacaaaaaaaactttattgagcttggagtgaagctatatatatggggcaagatcataatatgtttatatcggccttttcgttaactgaaaataatagttttgagaaatatatcaaatggtaaacagacatcatctttgaaaaataccatcaatgaagttaatattgttattggcatatggtttacccatcttaattttaatgcaaccaaacaaacaagaaacaaaaactgtataagatacaaggtgttttacgattttccgtcttaaaaccgaaatatttttgttcctacgactttaaacggactttgcttaagttgtgtgcatgtaagctcgtcgtccctcgattgtcatcaacattcaccaatatcagcctctatcacacgagtgaaggtggtgattcggcttaatgaaaacagagaaatatttcaatatgattcctattaaattttaaatcttttttctcaatctctagattttcattaaaagcatcatgatttttttccactatgttcatatatctctatcacagttttaggtacattgtagaaattggataagatacgtcatacgtctaacatgaatttggtctagcaaggaaggtttgagataataagtgaaaagaaaacacaagataataaattataatttataaatgctttatagtattgaaaaataagatgattttttttttttttaataccggattggctgatccacttatgatgactcaaatgttattaagtttcaagacaatttatgatgacacaaatcacaatgagtcaatagtagccacgaagccagaaaaaaaaaatgtactacaaaaagataatgatagtacaaaatgatacgtcgtactgccacatgtacgacacaactcgattaccaaaaagcagagccatccaaccataaaactcaaaacacacagattccactggcgtgtgctctcctcacttcactcgtccttgaaacttgaggtactga

SEQ ID NO: 934 - DNA, 1002 bp, Arabidopsis thaliana
  misc_feature (1)..(1002): Ceres Promoter YP0190
taaatagtgacattggtaagaagaaaaaaaacactattaaatagtgaaaaaatggtttataactctcttaattaacattacttattattgctagcacctaaaatctcccacaaaatatttgttgtaaaacacaaatttacaaaatgattttgtttttaaattagtaacacatgttcatatatacgttaataagaacataccctatatgattttatataaaaaaatttctttgagacgtcttattcttttttctttaataatatgcaattgtgagagtttggatttgaatggtagcattagaagcaaacttgaaccaaacatatttcatgaagtcaaacttgaaccaatgtgatcactaatcacagtgttcgcagtgtaaggcatcagaaaatagaagaagggacatagctatgaatcatataatcttgacacatgttttataggttttaggtgtgtatgctaacaaaaaatgagacagctttcttctaatagacttaatatttgggctaaatgtaccacagttgtgaatttcttacaaaaatgggccgagctacaaaaaactacaggcccactctcaactcttatcaaacgacagcgttttacttttttaaaagcacacactttttgtttggtgtcggtgacggtgagtttcgtccgctcttcctttaaattgaagcaacggttttgatccgatcaaatccaacggtgctgattacacaaagcccgagacgaaaacgttgactattaagttaggttttaatctcagccgttaatctacaaatcaacggttccctgtaaaacgaatcttccttccttcttcacttccgcgtcttctctctcaatcacctcaaaaaaatcgatttcatcaaaatattcacccgcccgaatttgactctccgatcatcgtctccgaatctagatcgacgagatcaaaaccctagaaatctaaatcggaatgagaaattgattttgatacgaattagggatctgtgtgttgaggac

SEQ ID NO: 935 - DNA, 995 bp, Arabidopsis thaliana
  misc_feature (1)..(995): Ceres Promoter YP0212
agtcgattggtacactcttaatttaattagagtaagagatcaacaaaaatatagaattttctttatatcgaagtgctacgaccttatatatatagaaaaaaaagcataggtgaatctctaaattgagattgtgctgtagtaaacatattaagtttttagtttttttaagaaatgaatctttttgttgattaattcaaactagtagtcattaagattccggagattccaatttagaaaagtcaaagattcaaagaacaagtccaggtccacatgttgaatccgattcatcatccactcatccttcatatcttcctccaccgtctccgcccaaaaaatcaataacaataaaaaatcctaaaaaaacatatttgattttgaaaaaactttatcatatattatattaattaaatagttatccgatgactcatcctatggtcagggccttgctgtctctgacgtccttaattatcattatttttaaatttgtctctctcagaaaattacgccacaatcttcctctttcccttttccgaaaacagctaatatttgtggacctaaactaaataacgtagcctctagattttatataattactaatactatatgctactacttgttattatttactccaatcatatatgataccaatcaagaatcactacataagtagaaaactttgcaatgagtccattaattaaaattaagaataaacttaaaattttatggtattttaagattccctttggattgtaatgacaagaaatcagcaaattagtcgtaactcgtaagaataaacaagatcaatttttactttctttacaaagattccgttgtaattttagaaatttttttttgtcactgtttttttatagattaatttatctgcatcaatccgattaagaagtgtacacatgggcatctatatatatctaacaggtaaaacgtgtatgtacatgcataaggttttacgtgcttctataaatatatgtggcagt

SEQ ID NO: 936 - DNA, 1024 bp, Arabidopsis thaliana
  misc_feature (1)..(1024): Ceres Promoter YP0214
ccagtcgattggcgcctcgcatgcctatcatatttaaccgtcaataatggatttggcggttttggtaggccgggtcaaccggattaaaagaaaacggtttggagtccttccttgcaattgaattttcacacattcgggttttgtgatttctctgtcataatgggcccggcacatatggttcataacccatgtgggcctatggtataatttttccaattaaaactattgttaggtcgataaaacaaaaaacaataaaaacgagtggaatacacataccaaaaagaatgtgatgaacattagtaattttattttgatggttaatgaaaaacaaaataaatgcatcttggcatcttccgttggaaagcgcaaatagggcagattttcagacagatatcactatgatggggggtgagagaaagaaaacgaggcgtacctaatgtaacactacttaattagtcgttagttataggactttttttttgtttgggcctagttataggatcataaggtaaaaatgaagaatgaatattagattagtaggagctaatgatggagttaagtatgcacgtgtaagaactgggaagtgaaacctcctgtatggtgaagaaactatacaacaaagccctttgttggtgtatacgtattaatttttattcttttatcacaagcgatacgtatcttaagacataataaatatatatcttactcataataaatatcttaagatatatatacagtatacacctgtatatatataataaataggcatatagtagaaattaatatgagttgttgttgttgcaaatatataaatcaatcaaaagatttaaaacccaccattcaatcttggtaagtaacgaaaaaaaagggaagcaagaagaaccacagaaaagggggctaacaactagacacgtagatcttcatctgcccgtccatctaacctaccacactctcatcttctttttcccgtgtcagtttgttatataagctctcactctccggtatatttccccattgcactgga

SEQ ID NO: 937 - DNA, 911 bp, Arabidopsis thaliana
  misc_feature (1)..(911): Ceres Promoter YP0263
atctagctgtggattccaccaaaattctggcagggccatgatctaaaaactgagactgcgcgtgttgttttgcagtgatttgtatttcatatttgcaccatcctacacagtccacttggtatcgtaaccaaacataaggagaacctaattacattattgttttaatttcgtcaaactggtttttaccttttagttacatagttgattcttcatttgttttagtagttatggagcacaataatgtgcaacaaagaaagatcatagtggattaatatgttgagaggtcagaaattcttggttaacaaaaaaaagttacaaggactgagattttgggtgggagaaagccatagcttttaaaacatgattgaacttaaaagtgatgttatggtttgaggggaaaaaggttgatgtcaactaagatagttgaagtaatgtcttaaactaaagtaaaccaccggtccaaccgtggtccggaagcatctctggtatgatttatcctaaaaatcaaaatagtagaaacatactttaaatatatacattgatcggacgaaaattgtaaactagtatagtttcaaaaactagttgaacaggttatgtaccttaaacatttatttcaaacttaaacactaaagaacatatatgaatagaagtttatataaattactatatatctaccataaatctcttataattatgatgtcacgatgaggaagtgttgaaacgttaaaatgccaaaatataagcatgcgacggaattttggcagaagattgtagagttgtaatctgtcgcaatcattactcgtgctagcatttttcattttcccttcatttgtggataacgcacgatataacattctacacaccaacaagattctataaaaacgcaaaggttgtctccatagaatatcgtc

SEQ ID NO: 938 - DNA, 999 bp, Arabidopsis thaliana
  misc_feature (1)..(999): Ceres Promoter YP0275
aaacattaatatgtagtaactatgggcgtatgctttactttttaaaatgggcctatgctataattgaatgacaaggattaaacaactaataaaattgtagatgggttaagatgacttatttttttacttaccaatttataaatgggcttcgatgtactgaaatatatcgcgcctattaacgaggccattcaacgaatgttttaagggccctatttcgacattttaaagaacacctaggtcatcattccagaaatggatattataggatttagataatttcccacgtttggtttatttatctattttttgacgttgaccaacataatcgtgcccaaccgtttcacgcaacgaatttatatacgaaatatatatatttttcaaattaagataccacaatcaaaacagctgttgattaacaaagagattttttttttttggttttgagttacaataacgttagaggataaggtttcttgcaacgattaggaaatcgtataaaataaaatatgttataattaagtgttttattttataatgagtattaatataaataaaacctgcaaaaggatagggatattgaataataaagagaaacgaaagagcaattttacttctttataattgaaattatgtgaatgttatgtttacaatgaatgattcatcgttctatatattgaagtaaagaatgagtttattgtgcttgcataatgacgttaacttcacatatacacttattacataacatttatcacatgtgcgtctttttttttttttactttgtaaaatttcctcacttttaagacttttataacaattactagtaaaataaagttgcttggggctacaccctttctccctccaacaactctatttatagataacattatatcaaaatcaaaacatagtccctttcttctataaaggttttttcacaaccaaatttccattataaatcaaaaaataaaaacttaattagtttttacagaagaaaagaaaaca

SEQ ID NO: 939 - DNA, 981 bp, Arabidopsis thaliana
  misc_feature (1)..(981): Ceres Promoter YP0285
gggattatatatgatagacgattgtatttgcgggacattgagatgtttccgaaaatagtcatcaaatatcaaaccagaatttgatgtgaaaacactaattaaaacatataattgacaactagactatatcatttgttaagttgagcgttgaaagaaaatgaaagagtgtagactgtagtacgtatgagtttcccaaaagatggtgcttgaatattattgggaagagactttggttggttcggttgaatgaagatttttacctgccatgttgatagagaaaggcaaataaatgtaggggtcgatgtctaacgtaaagactggatcaaccaagagtcctcctcctcgtcttcaccaaaaaaaaagagtcctcctcgtggaaacttatttcttctccagccaagatctcatctcatctcttcactctatgaaatataaaggaatcttatggtttttctaaaaactatagtacgtctatataccaaaggaaacaatataaaatcagttaatctgataaattttgagtaaataataaagttaactttgtacttacctatatcaaactaattcacaaaataaagtaataataacaaagaatttttagtagatccacaatatacacacacactatgagaaatcataatagagaattttaatgattttgtctaactcatagcaacaagtcgctttggccgagtggttaaggcgtgtgcctgctaagtacatgggctctgcccgcgagagttcgaatctctcaggcgacgtttcttttgttttcggccataaaggaaaaagcccaattaacacgtctcgcttataagcccataaagcaaacaatgggctgtctctgtctcactcacacacgcgttttcctactttttgactatttttataaccggcgggtctgacttaattagggttttctttaataatcagacactctctcactcgtttcgtcaacattgaacacagacaaaaccgcgt

SEQ ID NO: 940 - DNA, 996 bp, Arabidopsis thaliana
  misc_feature (1)..(996): Ceres Promoter YP0286
gaaaacaatcataggttacgctattatcatcgaaaggtatgtgatgcatattcccattgaaccagatttccatatattttatttgtaaagtgataatgaatcacaagatgattcaatattaaaaatgggtaactcactttgacgtgtagtacgtggaagaatagttagctatcacgcatacatatatctatgaataagtgtgtatgacataagaaactaaaatatttacctaaagtccagttactcatactgatttcatgcatatatgtattatttatttatttttaataaagaagcgattggtgttttcatagaaatcatgatagattgataggtatttcagttccacaaatctagatctgtgtgctatacatgcatgtattaattttttccccttaaatcatttcagttgataatattgctctttgttccaactttagaaaaggtatgaaccaacctgacgattaacaagtaaacattaattaatctttatatgagataaaaccgaggatatatatgattgtgttgctgtctattgatgatgtgtcgatattatgcttgttgtaccaatgctcgagccgagcgtgatcgatgccttgacaaactatatatgtttcccgaattaattaagttttgtatcttaattagaataacatttttatacaatgtaatttctcaagcagacaagatatgtatcctatattaattactatatatgaattgccgggcacctaccaggatgtttcaaatacgagagcccattagtttccacgtaaatcacaatgacgcgacaaaatctagaatcgtgtcaaaactctatcaatacaataatatatatttcaagggcaatttcgacttctcctcaactcaatgattcaacgccatgaatctctatataaaggctacaacaccacaaaggatcatcagtcatcacaaccacattaactcttcaccactatctctcaatctctcgtttcatttcttgacgcgtgaaaa

SEQ ID NO: 941 - DNA, 1000 bp, Arabidopsis thaliana
  misc_feature (1)..(1000): Ceres Promoter YP0337
taatttttttatttttggaactaacacttattagtttaggtttccatcacctatttaattcgtaattcttatacatgcatataatagagatacatatatacaaatttatgatcatttttgcacaacatgtgatctcattcattagtatgcattatgcgaaaacctcgacgcgcaaaagacacgtaatagctaataatgttactcatttataatgattgaagcaagacgaaaacaacaacatatatatcaaattgtaaactagatatttcttaaaagtgaaaaaaaacaaagaaatataaaggacaattttgagtcagtctcttaatattaaaacatatatacataaataagcacaaacgtggttacctgtcttcatgcaatgtggactttagtttatctaatcaaaatcaaaataaaaggtgtaatagttctcgtcatttttcaaattttaaaaatcagaaccaagtgatttttgtttgagtattgatccattgtttaaacaatttaacacagtatatacgtctcttgagatgttgacatgatgataaaatacgagatcgtctcttggttttcgaattttgaactttaatagttttcttttttagggaaactttaatagttgtttatcataagattagtcacctaatggttacgttgcagtaccgaaccaattttttacccttttttctaaatgtggtcgtggcataatttccaaaagagatccaaaacccggtttgctcaactgataagccggtcggttctggtttgaaaaacaagaaataatctgaaagtgtgaaacagcaacgtgtctcggtgtttcatgagccacctgccacctcattcacgtcggtcattttgtcgtttcacggttcacgctctagacacgtgctctgtccccaccatgactttcgctgccgactcgcttcgctttgcaaactcaaacatgtgtgtatatgtaagtttcatcctaataagcatctcttaccacattaattaaaaa

SEQ ID NO: 942 - DNA, 1000 bp, Arabidopsis thaliana
  misc_feature (1)..(1000): Ceres Promoter YP0356
ttagttcattgaaacgtcaactttttacttgcaaccactttgtaggaccattaactgcaaaataagaattctctaagcttcacaaggggttcgtttggtgctataaaaacattgttttaagaactggtttactggttctataaatctataaatccaaatatgaagtatggcaataataataacatgttagcacaaaaaatactcattaaattcctacccaaaaaaaatctttatatgaaactaaaacttatatacacaataatagtgatacaaagtaggtcttgatattcaactattcgggattttctggtttcgagtaattcgtataaaaggtttaagatctattatgttcactgaaatcttaactttgttttgtttccagttttaactagtagaaattgaaatttttaaaaattgttacttacaataaaatttgaatcaatatccttaatcaaaggatcttaagactagcacaattaaaacatataacgtagaatatctgaaataactcgaaaatatctgaactaagttagtagttttaaaatataatcccggtttggaccgggcagtatgtacttcaatacttgtgggttttgacgattttggatcggattgggcgggccagccagattgatctattacaaatttcacctgtcaacgctaactccgaacttaatcaaagattttgagctaaggaaaactaatcagtgatcacccaaagaaaacattcgtgaataattgtttgctttccatggcagcaaaacaaataggacccaaataggaatgtcaaaaaaaagaaagacacgaaacgaagtagtataacgtaacacacaaaaataaactagagatattaaaaacacatgtccacacatggatacaagagcatttaaggagcagaaggcacgtagtggttagaaggtatgtgatataattaatcggcccaaatagattggtaagtagtagccgtctatatcatccatactcatcataacttcaacct

SEQ ID NO: 943 - DNA, 1000 bp, Arabidopsis thaliana
  misc_feature (1)..(1000): Ceres Promoter YP0374
aagacacccgtaaatgttgtcatgtagaagaaactagaaacgttaaacgcatcaaatcaagaaattaaattgaaggtaatttttaacgccgcctttcaaatattcttcctaggagaggctacaagacgcgtatttctttcgaattctccaaaccattaccattttgatatataataccgacatgccgttgataaagtttgtatgcaaatcgttcattgggtatgagcaaatgccatccattggttcttgtaattaaatggtccaaaaatagtttgttcccactactagttactaatttgtatcactctgcaaaataatcatgatataaacgtatgtgctatttctaattaaaactcaaaagtaatcaatgtacaatgcagagatgaccataaaagaacattaaaacactacttccactaaatctatggggtgccttggcaaggcaattgaataaggagaatgcatcaagatgatatagaaaatgctattcagtttataacattaatgttttggcggaaaattttctatatattagacctttctgtaaaaaaaaaaaaatgatgtagaaaatgctattatgtttcaaaaatttcgcactagtataatacggaacattgtagtttacactgctcattaccatgaaaaccaaggcagtatataccaacattaataaactaaatcgcgatttctagcacccccattaattaattttactattatacattctctttgcttctcgaaataataaacttctctatatcattctacataataaataagaaagaaatcgacaagatctaaatttagatctattcagctttttcgcctgagaagccaaaattgtgaatagaagaaagcagtcgtcatcttcccacgtttggacgaaataaaacataacaataataaaataataaatcaaatatataaatccctaatttgtctttattactccacaattttctatgtgtatatatatacccacctctctcttgtgtatttg

SEQ ID NO: 944 - DNA, 998 bp, Arabidopsis thaliana
  misc_feature (1)..(998): Ceres Promoter YP0377
tataaaccattcctataacaccatatttaaacataacaatgaattgcttggatttcaaactttattaaatttggattttaaattttaatttgattgaattatacccccttaattggataaattcaaatatgtcaactttttttttgtaagatttttttatggaaaaaaaaattgattattcactaaaaagatgacaggttacttataatttaatatatgtaaaccctaaaaagaagaaaatagtttctgttttcactttaggtcttattatctaaacttctttaagaaaatcgcaataaattggtttgagttctaactttaaacacattaatatttgtgtgctatttaaaaaataatttacaaaaaaaaaaacaaattgacagaaaatatcaggttttgtaataagatatttcctgataaatatttagggaatataacatatcaaaagattcaaattctgaaaatcaagaatggtagacatgtgaaagttgtcatcaatatggtccacttttctttgctctataacccaaaattgaccctgacagtcaacttgtacacgcggccaaacctttttataatcatgctatttatttccttcatttttattctatttgctatctaactgatttttcattaacatgataccagaaatgaatttagatggattaattcttttccatccacgacatctggaaacacttatctcctaattaaccttactttttttttagtttgtgtgctccttcataaaatctatattgtttaaaacaaaggtcaataaatataaatatggataagtataataaatctttattggatatttctttttttaaaaaagaaataaatcttttttggatattttcgtggcagcatcataatgagagactacgtcgaaaccgctggcaaccacttttgccgcgtttaatttctttctgaggcttatataaatagatcaaaggggaaagtgagatataatacagacaaaacaagagaaaaga

SEQ ID NO: 945 - DNA, 999 bp, Arabidopsis thaliana
  misc_feature (1)..(999): Ceres Promoter YP0380
acaagtaccattcacttttttacttttcaatgtatacaatcatcatgtgataaaaaaaaaaatgtaaccaatcaacacactgagatacggccaaaaaatggtaatacataaatgtttgtaggttttgtaatttaaatactttagttaagttatgattttattatttttgcttatcacttatacgaaatcatcaatctattggtatctcttaatcccgctttttaatttccaccgcacacgcaaatcagcaaatggttccagccacgtgcatgtgaccacatattgtggtcacagtactcgtcctttttttttcttttgtaatcaataaatttcaatcctaaaacttcacacattgagcacgtcggcaacgttagctcctaaatcataacgagcaaaaaagttcaaattagggtatatgatcaattgatcatcactacatgtctacataattaatatgtattcaaccggtcggtttgttgatactcatagttaagtatatatgtgctaattagaattaggatgaatcagttcttgcaaacaactacggtttcatataatatgggagtgttatgtacaaaatgaaagaggatggatcattctgagatgttatgggctcccagtcaatcatgttttgctcgcatatgctatcttttgagtctcttcctaaactcatagaataagcacgttggttttttccaccgtcctcctcgtgaacaaaagtacaattacattttagcaaattgaaaataaccacgtggatggaccatattatatgtgatcatattgcttgtcgtcttcgttttcttttaaatgtttacaccactacttcctgacacgtgtccctattcacatcatccttgttatatcgttttacttataaaggatcacgaacaccaaaacatcaatgtgtacgtcttttgcataagaagaaacagagagcattatcaattattaacaattacacaagacagcgagattgtaaaagagtaagagagagag

SEQ ID NO: 946 - DNA, 1000 bp, Arabidopsis thaliana
  misc_feature (1)..(1000): Ceres Promoter YP0381
cacggtcaaagtattgctaacatggtcattacattgaaaaagaaaattaattgtctttactcatgtttattctatacaaataaaaatattaaccaaccatcgcactaacaaaatagaaatcttattctaatcacttaattgttgacaattaaatcattgaaaaatacacttaaatgtcaaatattcgttttgcatacttttcaatttaaatacatttaaagttcgacaagttgcgtttactatcatagaaaactaaatctcctaccaaagcgaaatgaaactactaaagcgacaggcaggttacataacctaacaaatctccacgtgtcaattaccaagagaaaaaaagagaagataagcggaacacgtggtagcacaaaaaagataatgtgatttaaattaaaaaacaaaaacaaagacacgtgacgacctgacgctgcaacatcccaccttacaacgtaataaccactgaacataagacacgtgtacgatcttgtctttgttttctcgatgaaaaccacgtgggtgctcaaagtccttgggtcagagtcttccatgattccacgtgtcgttaatgcaccaaacaagggtactttcggtattttggcttccgcaaattagacaaaacagctttttgtttgattgatttttctcttctctttttccatctaaattctctttgggctcttaatttctttttgagtgttcgttcgagatttgtcggagattttttcggtaaatgttgaaattttgtgggatttttttttatttctttattaaacttttttttattgaatttataaaaagggaaggtcgtcattaatcgaagaaatggaatcttccaaaatttgatattttgctgttttcttgggatttgaattgctctttatcatcaagaatctgttaaaatttctaatctaaaatctaagttgagaaaaagagagatctctaatttaaccggaattaatattctccgaccgaagttattatgttgcaggct

SEQ ID NO: 947 - DNA, 999 bp, Arabidopsis thaliana
  misc_feature (1)..(999): Ceres Promoter YP0384
tttaaaaaattggataaaacaccgataaaaattcacatttgcaaattttattcagtcggaatatatatttgaaacaagttttgaaatccattggacgattaaaattcattgttgagaggataaatatggatttgttcatctgaaccatgtcgttgattagtgattgactaccatgaaaaatatgttatgaaaagtataacaacttttgataaatcacatttattaacaataaatcaagacaaaatatgtcaacaataatagtagtagaagatattaattcaaattcatccgtaacaacaaaaaatcataccacaattaagtgtacagaaaaaccttttggatatatttattgtcgcttttcaatgattttcgtgaaaaggatatatttgtgtaaaataagaaggatcttgacgggtgtaaaaacatgcacaattcttaatttagaccaatcagaagacaacacgaacacttctttattataagctattaaacaaaatcttgcctattttgcttagaataatatgaagagtgactcatcagggagtggaaaatatctcaggatttgcttttagctctaacatgtcaaactatctagatgccaacaacacaaagtgcaaattcttttaatatgaaaacaacaataatatttctaatagaaaattaaaaagggaaataaaatatttttttaaaatatacaaaagaagaaggaatccatcatcaaagttttataaaattgtaatataatacaaacttgtttgcttccttgtctctccctctgtctctctcatctctcctatcttctccatatatacttcatcttcacacccaaaactccacacaaaatatctctccctctatctgcaaattttccaaagttgcatcctttcaatttccactcctctctaatataattcacattttcccactattgctgattcatttttttttgtgaattatttcaaacccacataaaaaaatctttgtttaaatttaaaacca

SEQ ID NO: 948 - DNA, 998 bp, Arabidopsis thaliana
  misc_feature (1)..(998): Ceres Promoter YP0385
actcaacaataggacaagccaaaaaaattccaattattgtgttactctattcttctaaatttgaacactaatagactatgacatatgagtatataatgtgaagtcttaagatattttcatgtgggagatgaataggccaagttggagtctgcaaacaagaagctcttgagccacgacataagccaagttgatgaccgtaattaatgaaactaaatgtgtgtggttatatattagggacccatggccatatacacaatttttgtttctgtcgatagcatgcgtttatatatatttctaaaaaaactaacatatttactggatttgagttcgaatattgacactaatataaactacgtaccaaactacatatgtttatctatatttgattgatcgaagaattctgaactgttttagaaaatttcaatacacttaacttcatcttacaacggtaaaagaaatcaccactagacaaacaatgcctcataatgtctcgaaccctcaaactcaagagtatacattttactagattagagaatttgatatcctcaagttgccaaagaattggaagcttttgttaccaaacttagaaacagaagaagccacaaaaaaagacaaagggagttaaagattgaagtgatgcatttgtctaagtgtgaaaggtctcaagtctcaactttgaaccataataacattactcacactccctttttttttctttttttttcccaaagtaccctttttaattccctctataacccactcactccattccctctttctgtcactgattcaacacgtggccacactgatgggatccacctttcctcttacccacctcccggtttatataaacccttcacaacacttcatcgctctcaaaccaactctctcttctctcttctctcctctcttctacaagaagaaaaaaaacagagcctttacacatctcaaaatcgaacttactttaaccaccaaatactgattgaacacacttgaaa

SEQ ID NO: 949 - DNA, 1000 bp, Arabidopsis thaliana
  misc_feature (1)..(1000): Ceres Promoter YP0396
catagtaaaagtgaatttaatcatactaagtaaaataagataaaacatgttatttgaatttgaatatcgtgggatgcgtatttcggtatttgattaaaggtctggaaaccggagctcctataacccgaataaaaatgcataacatgttcttccccaacgaggcgagcgggtcagggcactagggtcattgcaggcagctcataaagtcatgatcatctaggagatcaaattgtatgtcggccttctcaaaattacctctaagaatctcaaacccaatcatagaacctctaaaaagacaaagtcgtcgctttagaatgggttcggtttttggaaccatatttcacgtcaatttaatgtttagtataatttctgaacaacagaattttggatttatttgcacgtatacaaatatctaattaataaggacgactcgtgactatccttacattaagtttcactgtcgaaataacatagtacaatacttgtcgttaatttccacgtctcaagtctataccgtcatttacggagaaagaacatctctgtttttcatccaaactactattctcactttgtctatatatttaaaattaagtaaaaaagactcaatagtccaataaaatgatgaccaaatgagaagatggttttgtgccagattttaggaaaagtgagtcaaggtttcacatctcaaatttgactgcataatcttcgccattaacaacggcattatatatgtcaagccaattttccatgttgcgtacttttctattgaggtgaaaatatgggtttgttgattaatcaaagagtttgcctaactaatataactacgactttttcagtgaccattccatgtaaactctgcttagtgtttcatttgtcaacaatattgtcgttactcattaaatcaaggaaaaatatacaattgtataattttcttatattttaaaattaattttgatgtattacccctttataaataggctatcgctacaacaccaataac

SEQ ID NO: 950 - DNA, 1514 bp, Arabidopsis thaliana
  misc_feature (1)..(1514): Ceres Promoter p13879
tttcgatcctcttcttttttaggtttcttgatttgatgatcgccgccagtagagccgtcgtcggaagtttcagagattaaaaccatcaccgtgtgagttggtagcgaattaacggaaagtctaagtcaagattttttaaaaagaaatttatgtgtgaaaagaagccgttgtgtatatttatataatttagaaaatgtttcatcattttaattaaaaaattaataatttgtagaagaaagaagcattttttatacataaatcatttaccttctttactgtgtttttcttcacttacttcatttttacttttttacaaaaaagtgaaaagtaaattacgtaattggtaacataaattcactttaaatttgcatatgttttgttttcttcggaaactatatcgaaaagcaaacggaaagaacttcacaaaaaaccctagctaactaaagacgcatgtgttcttcttattcttcatatatcctctgtttcttgtgttctgttttgagtcttacattttcaatatctgactctgattactatatctaaaagggaacatgaagaacttgagaccatgttaaactgtacaatgccttcaaacatggctaactaaagatacattagatggctttacagtgtgtaatgcttattatctttaggttttttaaatcccttgtattaagttatttaccaaattatgttcttgtactgcttattggcttggttgttgtgtgctttgtaaacaacacctttggctttatttcatcctttgtaaacctactggtctttgttcagctcctcttggaagtgagtttgtatgcctggaacgggttttaatggagtgtttatcgacaaaaaaaaaatgtagcttttgaaatcacagagagtagttttatattcaaattacatgcatgcaactaagtagcaacaaagttgatatggccgagttggtctaaggcgccagattaaggttctggtccgaaagggcgtgggttcaaatcccactgtcaacattctctttttctcaaattaatatttttctgcctcaatggttcaggcccaattatactagactactatcgcgactaaaatagggactagccgaattgatccggcccagtatcagttgtgtatcaccacgttatttcaaatttcaaactaagggataaagatgtcatttgacatatgagatatttttttgctccactgagatatttttctttgtcccaagataaaatatcttttctcgcatcgtcgtctttccatttgcgcattaaaccaaaaagtgtcacgtgatatgtccccaaccactacgaattttaactacagatttaaccatggttaaaccagaattcacgtaaaccgactctaaacctagaaaatatctaaaccttggttaatatctcagcccccttataaataacgagacttcgtctacatcgttctacacatctcactgctcactactctcactgtaatcccttagatcttcttttcaaatttcaccattgcactggatg

SEQ ID NO: 951 - DNA, 1954 bp, Arabidopsis thaliana
  misc_feature (1)..(1954): Ceres Promoter p326
gtgggtaaaagtatccttctttgtgcatttggtatttttaagcatgtaataagaaaaaccaaaatagacggctggtatttaataaaaggagactaatgtatgtatagtatatgatttgtgtggaatataataaagttgtaaaatatagatgtgaagcgagtatctatcttttgactttcaaaggtgatcgatcgtgttctttgtgatagttttggtcgtcggtctacaagtcaacaaccaccttgaagttttcgcgtctcggtttcctcttcgcatctggtatccaatagcatacatataccagtgcggaaaatggcgaagactagtgggcttgaaccataaggtttggccccaatacggattccaaacaacaagcctagcgcagtcttttgggatgcataagactaaactgtcgcagtgatagacgtaagatatatcgacttgattggaatcgtctaagctaataagtttaccttgaccgtttatagttgcgtcaacgtccttatggagattgatgcccatcaaataaacctgaaaatccatcaccatgaccaccataaactcccttgctgccgctgctttggcttgagcaaggtgtttccttgtaaagctccgatctttggataaagtgttccactttttgcaagtagctctgacccctctcagagatgtcaccggaatcttagacagaacctcctctgccaaatcacttggaagatcggacaatgtcatcatttttgcaggtaatttctccttcgttgctgctttggcttgagcacggtgcttctttgtaaagctccgatctttggataagagcggatcggaatcctctaggaggtgccagtcccttgacctattaatttatagaaggttttagtgtattttgttccaatttcttctctaacttaacaaataacaactgcctcatagtcatgggcttcaaattttatcgcttggtgtatttcgttatttgcaaggccttggcccattttgagcccaataactaaatctagccttttcagaccggacatgaacttcgcatattggcgtaactgtgcagttttacctttttcggatcagacaagatcagatttagaccacccaacaatagtcagtcatatttgacaacctaagctagccgacactactaaaaagcaaacaaaagaagaattctatgttgtcattttaccggtggcaagtggacccttctataaaagagtaaagagacagcctgtgtgtgtataatctctaattatgttcaccgacacaatcacacaaacccttctctaatcacacaacttcttcatgatttacgacattaattatcattaactctttaaattcactttacatgctcaaaaatatctaatttgcagcattaatttgagtaccgataactattattataatcgtcgtgattcgcaatcttcttcattagatgctgtcaagttgtactcgcacgcggtggtccagtgaagcaaatccaacggtttaaaaccttcttacatttctagatctaatctgaaccgtcagatatctagatctcattgtctgaacacagttagatgaaactgggaatgaatctggacgaaattacgatcttacaccaaccccctcgacgagctcgtatatataaagcttatacgctcctccttcaccttcgtactactactaccaccacatttctttagctcaaccttcattactaatctccttttaaggtatgttcacttttcttcgattcatactttctcaagattcctgcatttctgtagaatttgaaccaagtgtcgatttttgtttgagagaagtgttgatttatagatctggttattgaatctagattccaatttttaattgattcgagtttgttatgtgtgtttatactacttctcattgatcttgtttgatttctctgctctgtattaggtttctttcgtgaatcagatcggaa

SEQ ID NO: 952 - DNA, 2016 bp, Arabidopsis thaliana
  misc_feature (1)..(2016): Ceres Promoter p32449
gatcggccttcttcaggtcttctctgtagctctgttacttctatcacagttatcgggtatttgagaaaaaagagttagctaaaatgaatttctccatataatcatggtttactacaggtttacttgattcgcgttagctttatctgcatccaaagttttttccatgatgttatgtcatatgtgataccgttactatgtttataactttatacagtctggttcactggagtttctgtgattatgttgagtacatactcattcatcctttggtaactctcaagtttaggttgtttgaattgcctctgttgtgatacttattgtctattgcatcaatcttctaatgcaccaccctagactatttgaacaaagagctgtttcattcttaaacctctgtgtctccttgctaaatggtcatgctttaatgtcttcacctgtctttctcttctatagatatgtagtcttgctagatagttagttctacagctctcttttgtagtcttgttagagagttagttgagatattacctcttaaaagtatccttgaacgctttccggttatgaccaatttgttgtagctccttgtaagtagaacttactgggaccagcgagacagtttatgtgaatgttcatgcttaagtgtcgaacgtatctatctctactatagctctgtagtcttgttagacagttagttttatatctccatttttttgtagtcttgctagttgagatattacctcttctcttcaaagtatccttgaacgctcaccggttatgaaatctctacactatagctctgtagtcttgctagatagttagttctttagctctctttttgtagcctagttctttagctctccttttgtagccttgctacagagtaagatgggatattacctccttgaacgctctccggttatgaccaatttgttgtagctccttgtaagtagaacttaggatagagtgagtcaactttaagaaagaacctagtatgtggcataaccagattgcaggctctgtctcggctacagtaacgtaactctatagctctttgttttgttcagaaagaaccagtgattggatgattcgtccttagaaactggacctaacaacagtcattggctttgaaatcaagccacaacaatgcctatatgaaccgtccatttcatttatccgtttcaaaccagcccattacatttcgtcccattgataaccaaaagcggttcaatcagattatgttttaattttaccaaattctttatgaagtttaaattatactcacattaaaaggattattggataatgtaaaaattctgaacaattactgattttggaaaattaacaaatattctttgaaatagaagaaaaagcctttttccttttgacaacaacatataaaatcatactcccattaaaaagattttaatgtaaaattctgaatataagatattttttacaacaacaaccaaaaatatttatttttttccttttttacagcaacaagaaggaaaaacttttttttttgtcaagaaaaggggagattatgtaaacagataaaacagggaaaataactaaccgaactctcttaattaacatcttcaaataaggaaaattatgatccgcatatttaggaagatcaatgcattaaaacaacttgcacgtggaaagagagactatacgctccacacaagttgcactaatggtacctctcacaaaccaatcaaaatactgaataatgccaacgtgtacaaattagggttttacctcacaaccatcgaacattctcgaaacattttaaacagcctggcgccatagatctaaactctcatcgaccaatttttgaccgtccgatggaaactctagcctcaacccaaaactctatataaagaaatcttttccttcgttattgcttaccaaatacaaaccctagccgccttattcgtcttcttcgttctctagttttttcctcagtctctgttcttagatcccttgtagtttccaaatcttccgataaggcct

SEQ ID NO: 953 - DNA, 667 bp, Arabidopsis thaliana
  misc_feature (1)..(667): Ceres Promoter PD1367
acagttttcttttctcatcttacaacaagtttccaggaggatagagacataaacgaagctcggattgtatcgttctttttagcttttattcacatccgaaagtcctgtagtttagattctgttatcttgcggttttgagttaatcagaaacagagtaatcaatgtaatgttgcaggctagatctttcatctttggaaatttgtttttttctcatgcaatttctttagcttgaccatgagtgactaaaagatcaatcagtagcaatgatttgatttggctaagagacatttgtccacttggcatcttgatttggatggttacaacttgcaagacccaattggatacttgctatgacaactccaactcaagagtgtcgtgtaactaagaaccttgactaatttgtaatttcaatcccaagtcatgttactatatgtttttttgtttgtattattttctctcctacaattaagctctttgacgtacgtaatctccggaaccaactcctatatccaccatttactccacgttgtctccaattattggacgttgaaacttgacacaacgtaaacgtatctacgtggttgattgtatgtacatatgtacaaacgtacacctttctcctctttcacttcatcacttggcttgtgaattcattaattcctgcgaa

SEQ ID NO: 954 - DNA, 252 bp, Arabidopsis thaliana
  misc_feature (1)..(252): Ceres Promoter PD0898
cgcaggcccgatcggcctaaataattatagtcataagaggacccaaataaataaataatgggattctctgaggtgtatttttttatgcacacgtaaaagcgtgaaagatttgtaaacctactttatatatatacttccatctctttgtctttgttacaatttgaatcagagagaaattaagaagcgaaaaacaaagaacgagaggaggcgagaggtatagaagaatattccttgtggccggcaaggccaatc

SEQ ID NO: 955 - DNA, 669 bp, Arabidopsis thaliana
  misc_feature (1)..(669): Ceres GDNA ANNOT ID no. 848446
  misc_feature (1)..(669): Also Known As GEMINI ID no. 5110E1
atggattctgaacccggccagccagagaacggtactgatgctgagaaatctgttgtaggaaaatgttctgagacgatcagtgactcagaacctggccagcctgagaacggcactgaagccgagaaatctgttgtgcaaaaatgttctgagaagatcgatgaatctgaagccggccagcctgagaacagtactgaagccgagaaattcgttgtgcggaaatgttctgagaagatcgatggctctgaaaatgttcctgcagctggttgtgttattaggactgatctaaactcgtgtcctgagtttgagaagaaacctttgtttttgaccaaaaactggaggaacatcctatgcagatgcgaaaagtgccttgagatgtataagcagagaaaggtaagctatctacttgatgcagaggacacaattgttgaatacgagaagaaggcgaaggaaaaaagaacagagaaactggagaaacaagaaggtgaagcacttgatcttctgaataatctagaccacgtatccaaagttgagctccttcacggaatcaaagacttccaagacggactccagggtttaatggagtctgctgggccatcaaaggcgataacttctgcagatatcgagcaaatgttttcaaaactgaaaaacaaacgtaaaaggatggagtga

SEQ ID NO: 956 - protein, 222 aa, Arabidopsis thaliana
  misc_feature (1)..(222): Ceres GDNA ANNOT ID no. 848446
  misc_feature (1)..(222): Also Known As GEMINI ID no. 5110E1
MDSEPGQPENGTDAEKSVVGKCSETISDSEPGQPENGTEAEKSVVQKCSEKIDESEAGQPENSTEAEKFVVRKCSEKIDGSENVPAAGCVIRTDLNSCPEFEKKPLFLTKNWRNILCRCEKCLEMYKQRKVSYLLDAEDTIVEYEKKAKEKRTEKLEKQEGEALDLLNNLDHVSKVELLHGIKDFQDGLQGLMESAGPSKAITSADIEQMFSKLKNKRKRME

What is claimed is:

1. A method of producing a plant tissue having an increased level of one or more terpenes, said method comprising:
   a) growing a plant expressing an exogenous regulatory protein, said plant comprising an exogenous nucleic acid, said exogenous nucleic acid comprising a regulatory region operably linked to a nucleic acid encoding said regulatory protein, said regulatory protein comprising an amino acid sequence having 95% or greater sequence identity to the amino acid sequence set forth in SEQ ID NO:690; and
   b) collecting tissue from said plant, wherein said tissue has said increased level of one or more terpenes.

2. The method of claim 1, said plant further comprising an endogenous gene involved in terpenoid biosynthesis, said endogenous gene comprising an endogenous regulatory region, wherein said regulatory protein and said endogenous regulatory region are associated.

3. The method of claim 1, wherein said plant is from a genus selected from the group consisting of *Aesculus, Anamirta, Andrographis, Artemisia, Betula, Bixa, Cannabis, Centella, Chrysanthemum, Tanacetum, Cinnamomum, Citrullus, Luffa, Coleus, Curcuma, Cymbopogan, Daphne, Euphorbia, Glycine, Glycyrrhiza, Gossypium, Parthenium, Hevea, Isodon, Rabdosia, Mentha, Salvia, Rosmarinus, Lavandula, Thymus, Origanum, Ocimum, Simarouba, Taxus, Cephalotaxus, Thymus, Tripterygium, Lycopersicon, Alstroemeria, Convallaria, Digitalis, Dioscorea, Calendula, Ruscus, Strophanthus, Brassica, Fragaria, Vitis, Coffea, Musa, Lactuca, Solanum, Triticum, Zea, Oryza*, and *Acokanthera*.

4. The method of claim 1, wherein said plant is a species selected from *Artemisia annua, Andrographis paniculata, Bixa orellana, Cannabis sativa, Tanacetum parthenium, Chrysanthemum parthenium, Coleus forskohlii, Glycine max, Glycyrrhiza glabra, Parthenium argentatum, Rosmarinus officinalis, Taxus baccata, Taxus brevifolia, Tripterygium wilfordii, Cinnamommum camphora, Mentha spicata, Mentha piperita, Lycopersicon esculentum, Digitalis lanata, Digitalis purpurea, Calendula officinalis, Musa paradisiaca, Theobroma cacao, Coffea arabica, Zea mays, Vitis vinifera, Lactuca sativa, Ananus comosus, Solanum tuberosum, Oryza sativa*, and *Brassica oleracea*.

5. The method of claim 1, wherein said regulatory region is a promoter.

6. The method of claim 5, wherein said promoter is a tissue-preferential promoter.

7. The method of claim 6, wherein said tissue-preferential promoter is a fruit, seed, or seed pod tissue-preferential promoter.

8. The method of claim 6, wherein said tissue-preferential promoter is a root, tuber, or stem tissue-preferential promoter.

9. The method of claim 6, wherein said tissue-preferential promoter is an inflorescence or leaf tissue-preferential promoter.

10. The method of claim 5, wherein said promoter is a cell type-preferential promoter.

11. The method of claim 5, wherein said promoter is an inducible promoter.

12. The method of claim 1, wherein the level of said one or more terpenes is increased at least two fold.

13. The method of claim 1, wherein said one or more terpenes are amyrin, lupeol, and cycloartenol.

14. A method of making a plant having an increased level of one or more terpenes, said method comprising:
   a) introducing an exogenous nucleic acid into a plurality of plant cells, said exogenous nucleic acid comprising a regulatory region operably linked to a nucleic acid encoding a regulatory protein, said regulatory protein comprising an amino acid sequence having 95% or greater sequence identity to the amino acid sequence set forth in SEQ ID NO:690;
   b) selecting a plant produced from said plurality of plant cells that has an increased level of one or more terpenes.

15. The method of claim 14, said plant further comprising an endogenous gene involved in terpenoid biosynthesis, said endogenous gene comprising an endogenous regulatory region, wherein said regulatory protein and said endogenous regulatory region are associated.

16. The method of claim 14, wherein said plant is from a genus selected from the group consisting of *Aesculus, Anamirta, Andrographis, Artemisia, Betula, Bixa, Cannabis, Centella, Chrysanthemum, Tanacetum, Cinnamomum, Citrullus, Luffa, Coleus, Curcuma, Cymbopogan, Daphne, Euphorbia, Glycine, Glycyrrhiza, Gossypium, Parthenium, Hevea, Isodon, Rabdosia, Mentha, Salvia, Rosmarinus, Lavandula, Thymus, Origanum, Ocimum, Simarouba, Taxus, Cephalotaxus, Thymus, Tripterygium, Lycopersicon, Alstroemeria, Convallaria, Digitalis, Dioscorea, Calendula, Ruscus, Strophanthus, Brassica, Fragaria, Vitis, Coffea, Musa, Lactuca, Solanum, Triticum, Zea, Oryza*, and *Acokanthera*.

17. The method of claim 14, wherein said plant is a species selected from *Artemisia annua, Andrographis paniculata, Bixa orellana, Cannabis sativa, Tanacetum parthenium, Chrysanthemum parthenium, Coleus forskohlii, Glycine max, Glycyrrhiza glabra, Parthenium argentatum, Rosmarinus officinalis, Taxus baccata, Taxus brevifolia, Tripterygium wilfordii, Cinnamommum camphora, Mentha spicata, Mentha piperita, Lycopersicon esculentum, Digitalis lanata, Digitalis purpurea, Calendula officinalis, Musa paradisiaca, Theobroma cacao, Coffea arabica, Zea mays, Vitis vinifera, Lactuca sativa, Ananus comosus, Solanum tuberosum, Oryza sativa*, and *Brassica oleracea*.

18. The method of claim 14, wherein the level of said one or more terpenes is increased at least two fold.

19. The method of claim 14, wherein said one or more terpenes are amyrin, lupeol, and cycloartenol.

20. A plant produced by the method of claim 14, said plant having an increased level of one or more terpenes.

* * * * *